US011312761B2

(12) United States Patent
Walker

(10) Patent No.: US 11,312,761 B2
(45) Date of Patent: Apr. 26, 2022

(54) ANTI-RESPIRATORY SYNCYTIAL VIRUS ANTIBODIES, AND METHODS OF THEIR GENERATION AND USE

(71) Applicant: Adimab, LLC, Lebanon, NH (US)

(72) Inventor: Laura M. Walker, Lebanon, NH (US)

(73) Assignee: Adimab, LLC, Lebanon, NH (US)

( * ) Notice: Subject to any disclaimer, the term of this patent is extended or adjusted under 35 U.S.C. 154(b) by 76 days.

(21) Appl. No.: 16/343,297

(22) PCT Filed: Oct. 20, 2017

(86) PCT No.: PCT/US2017/057720
§ 371 (c)(1),
(2) Date: Apr. 18, 2019

(87) PCT Pub. No.: WO2018/075961
PCT Pub. Date: Apr. 26, 2018

(65) Prior Publication Data

US 2019/0256581 A1 Aug. 22, 2019

Related U.S. Application Data

(60) Provisional application No. 62/411,500, filed on Oct. 21, 2016.

(51) Int. Cl.
| | |
|---|---|
| *C07K 16/10* | (2006.01) |
| *A61P 31/16* | (2006.01) |
| *A61K 9/00* | (2006.01) |
| *A61K 39/12* | (2006.01) |
| *C12N 15/85* | (2006.01) |
| *A61K 45/06* | (2006.01) |

(52) U.S. Cl.
CPC ........ *C07K 16/1027* (2013.01); *A61K 9/0019* (2013.01); *A61K 39/12* (2013.01); *A61P 31/16* (2018.01); *C12N 15/85* (2013.01); *A61K 45/06* (2013.01); *C12N 2760/18534* (2013.01)

(58) Field of Classification Search
None
See application file for complete search history.

(56) References Cited

U.S. PATENT DOCUMENTS

| | | | |
|---|---|---|---|
| 5,866,125 | A | 2/1999 | Brams et al. |
| 2002/0141990 | A1 | 10/2002 | Deen et al. |
| 2016/0024188 | A1 | 1/2016 | van den Brink et al. |
| 2018/0025435 | A1 | 1/2018 | Karame et al. |
| 2019/0256580 | A1 | 8/2019 | Walker |
| 2020/0223906 | A1 | 7/2020 | Walker |

FOREIGN PATENT DOCUMENTS

| | | | |
|---|---|---|---|
| JP | 2010-534057 | A | 11/2010 |
| JP | 2011-514139 | A | 5/2011 |
| JP | 2019-521450 | A | 7/2019 |
| WO | WO-2008/106980 | A2 | 9/2008 |
| WO | WO-2009/030237 | A2 | 3/2009 |
| WO | WO-2014/121021 | A1 | 8/2014 |
| WO | WO-2018/075954 | A2 | 4/2018 |
| WO | WO-2018/075961 | A1 | 4/2018 |
| WO | WO-2018/075974 | A2 | 4/2018 |

OTHER PUBLICATIONS

Rudikoff et al, Proc. Natl. Acad. Sci. USA, 79:1979-1983 (Year: 1982).*
Casset et al., Biochemical and Biophysical Research Communications, 307:198-205 (Year: 2003).*
Paul, Fundamental Immunology, 3rd Edition, pp. 292-295 (Year: 1993).*
Coleman P. M. (Research in Immunology, 145:33-36 (Year: 1994).*
Gilman, M. et al., Rapid profiling of RSV antibody repertoires from the memory B cells of naturally infected adult donors, Sci Immunol, 1(6). pii: eaaj1879 (2016).
International Search Report for PCT/US2017/257720 (Anti-Respiratory Syncytial Virus Antibodies, and Methods of Their Generation and Use, filed Oct. 20, 2017), issued by ISA/EPO, 10 pages (dated Mar. 13, 2018).
Liang, B. et al., Enhanced Neutralizing Antibody Response Induced by Respiratory Syncytial Virus Prefusion F Protein Expressed by a Vaccine Candidate, Journal of Virology, 89(18):9499-9510 (2015).
Liang, B. et al., Packaging and Prefusion Stabilization Separately and Additively Increase the Quantity and Quality of Respiratory Syncytial Virus (RSV)-Neutralizing Antibodies Induced by an RSV Fusion Protein Expressed by a Parainfluenza Virus Vector, Journal of Virology, 90(21):10022-10038 (2016).
Magro, M. et al., Neutralizing antibodies against the preactive form of respiratory syncytial virus fusion protein offer unique possibilities for clinical intervention, Proc Natl Acad Sci USA, 109(8):3089-94 (2012).
McLellan, Jason S., Neutralizing epitopes on the respiratory syncytial virus fusion glycoprotein, Curr Opin Virol, 11:70-5 (2015).
Mechelen, L. et al., RSV neutralization by palivizumab, but not by monoclonal antibodies targeting other epitopes, is augmented by Fc gamma receptors, Antiviral Research, 132:1-5 (2016).
Ngwuta, J. et al., Prefusion F-specific antibodies determine the magnitude of RSV neutralizing activity in human sera, Sci Transl Med, 7(309):309ra162 (2015).
Raghunandan, R. et al., An insect cell derived respiratory syncytial virus (RSV) F nanoparticle vaccine induces antigenic site II antibodies and protects against RSV challenge in cotton rats by active and passive immunization, Vaccine, 32(48):6485-92 (2014).
Written Opinion for PCT/US2017/257720 (Anti-Respiratory Syncytial Virus Antibodies, and Methods of Their Generation and Use, filed Oct. 20, 2017), issued by ISA/EPO, 12 pages (dated Mar. 13, 2018).

(Continued)

*Primary Examiner* — Shanon A. Foley
*Assistant Examiner* — Myron G Hill
(74) *Attorney, Agent, or Firm* — Choate, Hall & Stewart LLP; Brenda Herschbach Jarrell

(57) ABSTRACT

Anti-RSV antibodies with neutralizing potency against RSV subtype A and RSV subtype B are provided, as well as methods for their identification, isolation, generation, and methods for their preparation and use are provided.

18 Claims, 14 Drawing Sheets

Specification includes a Sequence Listing.

(56) References Cited

OTHER PUBLICATIONS

Corti, D. et al., Cross-neutralization of four paramyxoviruses by a human monoclonal antibody, Nature, 501(7467):439-443 (2013).

Giersing, B. et al., Meeting report: WHO consultation on Respiratory Syncytial Virus (RSV) vaccine development, Geneva, Apr. 25-26, 2016, Vaccine, 8 pages (2017).

Huang, J. et al., Antibody Epitopes of Pneumovirus Fusion Proteins, Front Immunol., 10:2778, 8 pages (2019).

International Search Report for PCT/US17/57708 (Anti-Respiratory Syncytial Virus Antibodies, and Methods of Their Generation and Use, filed Oct. 20, 2017), issued by ISA/EP, 10 pages (dated Aug. 30, 2018).

International Search Report for PCT/US2017/057737 (Anti-Respiratory Syncytial Virus Antibodies, and Methods of Their Generation and Use, filed Oct. 20, 2017), issued by ISA/EP, 10 pages (dated Aug. 30, 2018).

Janeway, C. et al., Immunobiology: The Immune System in Health and Disease, 5 pages (2005).

Schuster, J. et al., A Broadly Neutralizing Human Monoclonal Antibody Exhibits In Vivo Efficacy Against Both Human Metapneumovirus and Respiratory Syncytial Virus, Journal of Infectious Diseases, 211(2):216-225 (2014).

Sela-Culang, I. et al., The structural basis of antibody-antigen recognition, Frontiers in Immunology, 4: 13 pages (2013).

Stryer, Lubert, Biochemistry, 4th Edition, WH Freeman and Company, New York, 8 pages (1995).

Written Opinion for PCT/US17/57708 (Anti-Respiratory Syncytial Virus Antibodies, and Methods of Their Generation and Use, filed Oct. 20, 2017), issued by ISA/EP, 15 pages (dated Aug. 30, 2018).

Written Opinion for PCT/US2017/057737 (Anti-Respiratory Syncytial Virus Antibodies, and Methods of Their Generation and Use, filed Oct. 20, 2017), issued by ISA/EP, 14 pages (dated Aug. 30, 2018).

McLellan, J. S. et al., Structure of RSV Fusion Glycoprotein Trimer Bound to a Prefusion-Specific Neutralizing Antibody, Science, 340;1113-1117 (2013).

\* cited by examiner

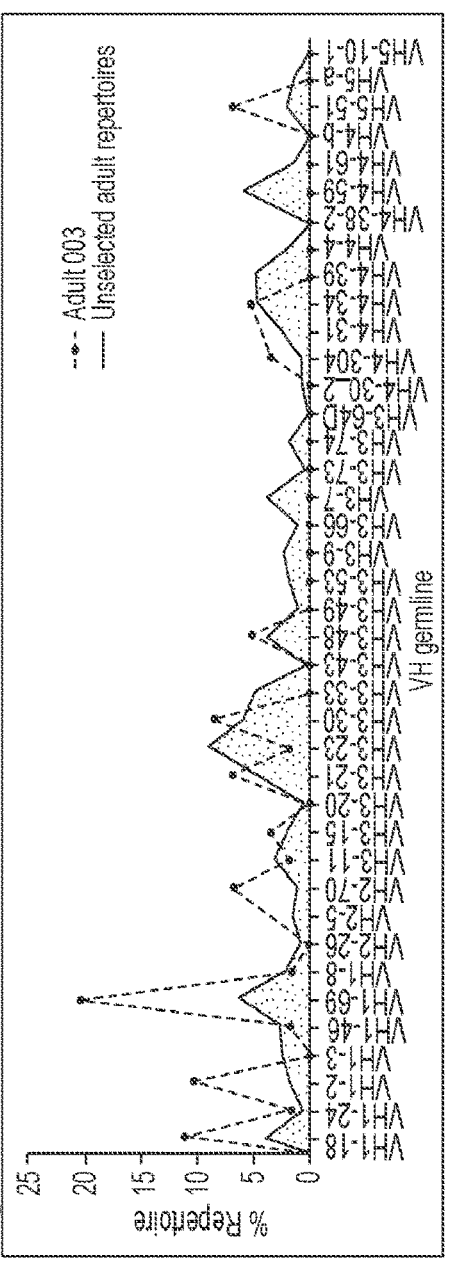
Figure 1C
Figure 1D
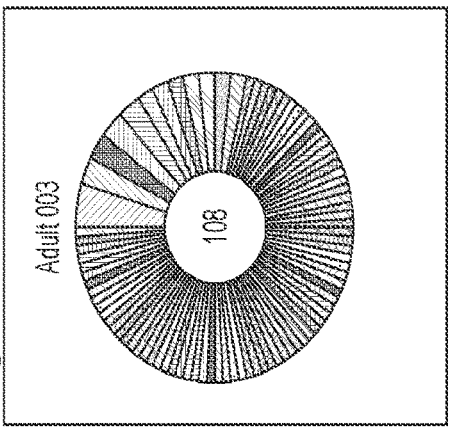
Figure 1E
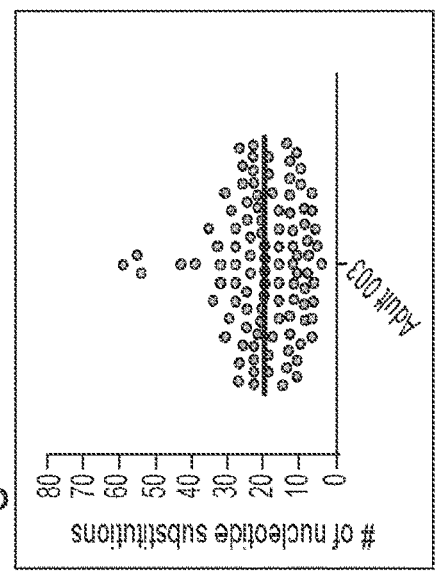
Figure 1F

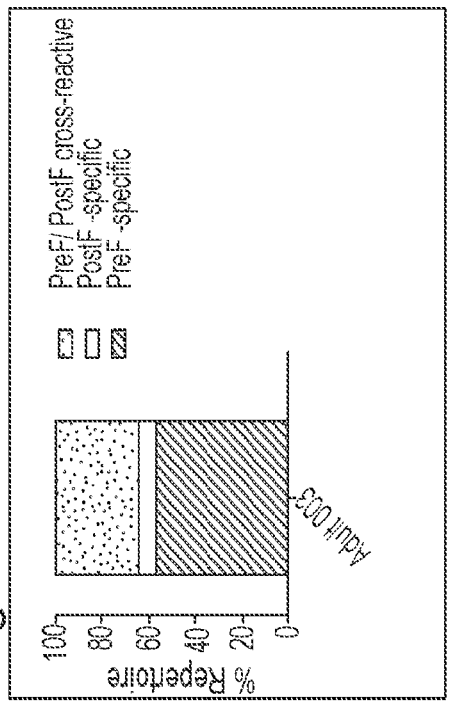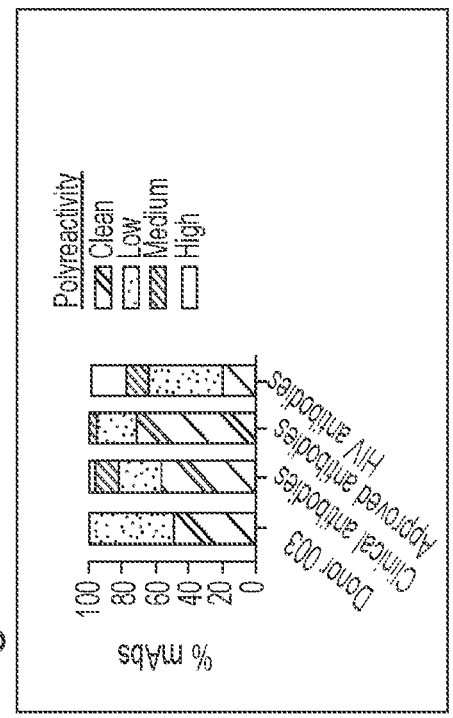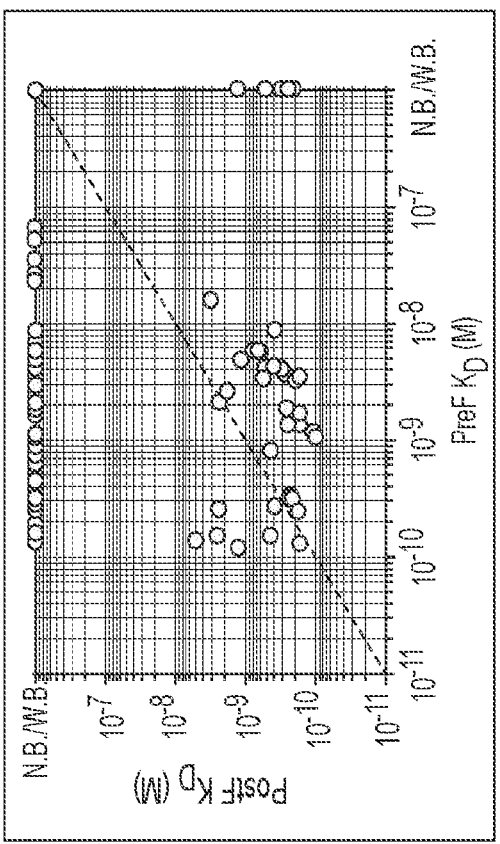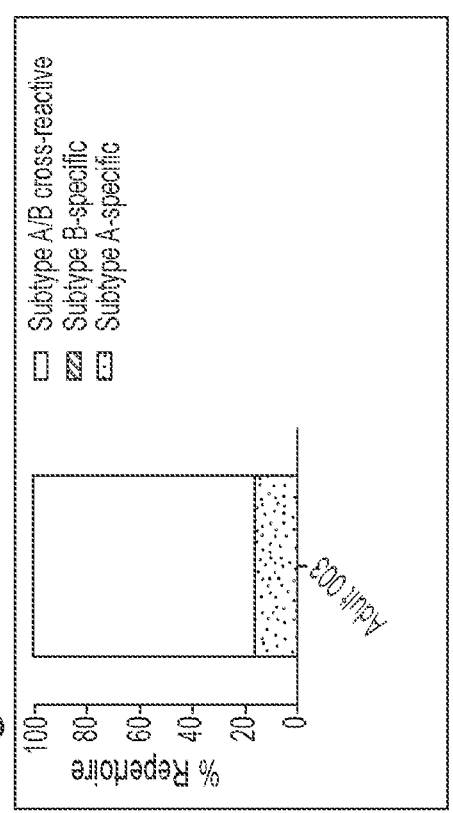
Figure 2A
Figure 2B
Figure 2C
Figure 2D

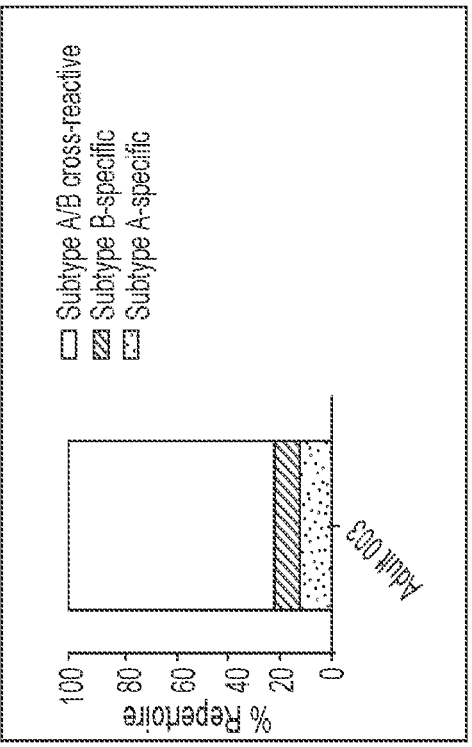
Figure 4C
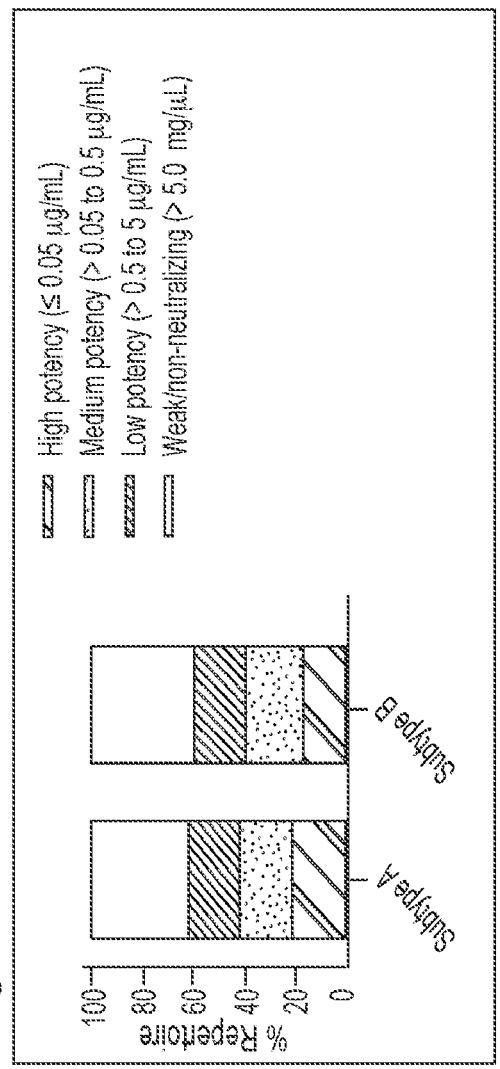
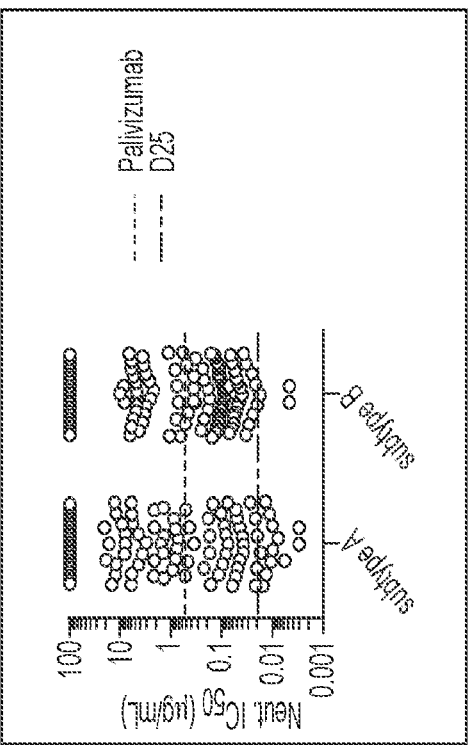
Figure 4A
Figure 4B

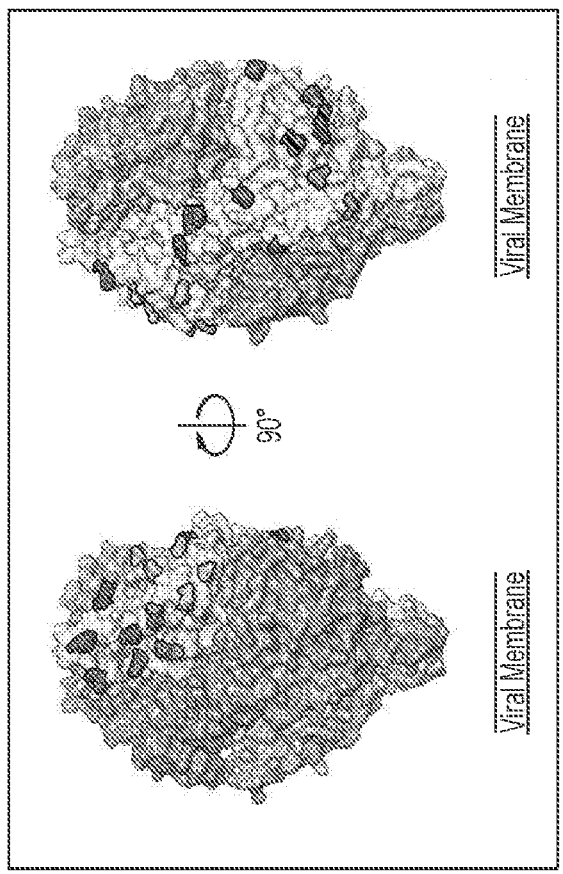
Figure 7A
Figure 7B
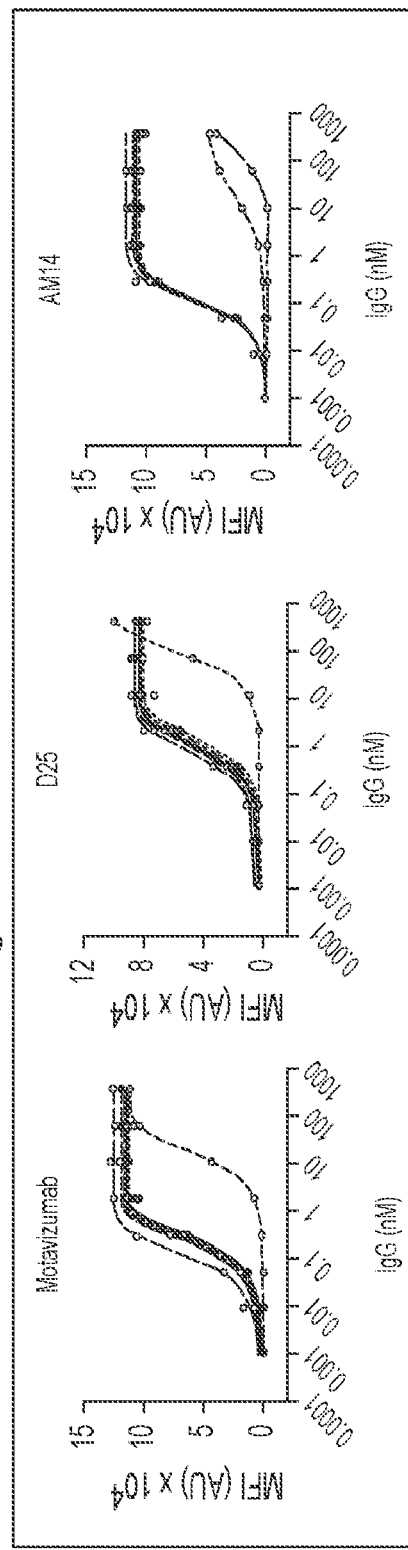
Figure 7C

ANTI-RESPIRATORY SYNCYTIAL VIRUS ANTIBODIES, AND METHODS OF THEIR GENERATION AND USE

CROSS REFERENCE TO RELATED APPLICATIONS

The present application is the National Stage of International Application No. PCT/US2017/057720, filed Oct. 20, 2017, which claims the benefit of U.S. Provisional Patent Application No. 62/411,500, filed Oct. 21, 2016, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Oct. 20, 2017, is named "2009186_0217_SL.TXT" and is 860,021 bytes in size.

FIELD OF THE INVENTION

The invention relates, inter alia, to anti-Respiratory Syncytial Virus (RSV) antibodies and functional fragments thereof, and methods and reagents for their preparation and use.

BACKGROUND OF THE INVENTION

All references cited herein, including without limitation patents, patent applications, and non-patent references and publications referenced throughout are hereby expressly incorporated by reference in their entireties for all purposes.

Respiratory syncytial virus (RSV) causes substantial morbidity and mortality in young children and the elderly, is the leading cause of infant hospitalization in the United States and accounts for an estimated 64 million infections and 160,000 deaths world-wide each year. However, despite decades of research, the development of a safe and effective vaccines or therapeutic and/or prophylactic antibodies against RSV has remained elusive, highlighting the need for novel strategies that induce or provide protective immune responses. (1-3). Indeed, to date there are currently no approved RSV vaccines, and passive prophylaxis with the monoclonal antibody palivizumab (marketed as Synagis®) is restricted to high-risk infants in part due to its modest efficacy.

Certain populations of children are at risk for developing an RSV infection and these include preterm infants (Hall et al., 1979, New Engl. J. Med. 300:393-396), children with congenital malformations of the airway, children with bronchopulmonary dysplasia (Groothuis et al., 1988, Pediatrics 82:199-203), children with congenital heart disease (MacDonald et al., New Engl. J. Med. 307:397-400), and children with congenital or acquired immunodeficiency (Ogra et al., 1988, Pediatr. Infect. Dis. J. 7:246-249; and Pohl et al., 1992, J. Infect. Dis. 165:166-169), and cystic fibrosis (Abman et al., 1988, J. Pediatr. 1 13:826-830).

RSV can infect the adult population as well. In this population, RSV causes primarily an upper respiratory tract disease, although elderly patients may be at greater risk for a serious infection and pneumonia (Evans, A. S., eds., 1989, Viral Infections of Humans. Epidemiology and Control, 3$^{rd}$ ed., Plenum Medical Book, New York at pages 525-544), as well as adults who are immunosuppressed, particularly bone marrow transplant patients (Hertz et al., 1989, Medicine 68:269-281). Other at risk patients include those suffering from congestive heart failure and those suffering from chronic obstructive pulmonary disease (ie. COPD). There have also been reports of epidemics among nursing home patients and institutionalized young adults (Falsey, A. R., 1991, Infect. Control Hosp. Epidemiol. 12:602-608; and Garvie et al., 1980, Br. Med. J. 281:1253-1254).

While treatment options for established RSV disease are limited, more severe forms of the disease of the lower respiratory tract often require considerable supportive care, including administration of humidified oxygen and respiratory assistance (Fields et al., eds, 1990, Fields Virology, 2$^{nd}$ ed., Vol. 1, Raven Press, New York at pages 1045-1072).

Similar to other pneumoviruses, RSV expresses two major surface glycoproteins: the fusion protein (F) and the attachment protein (G). Although both have been shown to induce protective neutralizing antibody responses, F is less genetically variable than G, is absolutely required for infection, and is the target for the majority of neutralizing activity in human serum (4-8). RSV F is also the target of the monoclonal antibody palivizumab, which is used to passively protect high-risk infants from severe disease (9). Consequently, the RSV F protein is considered to be a highly attractive target for vaccines and antibody-based therapies.

The mature RSV F glycoprotein initially exists in a metastable prefusion conformation (10), before undergoing a conformational change that leads to insertion of the hydrophobic fusion peptide into the host-cell membrane. Subsequent refolding of F into a stable, elongated postfusion conformation (postF) (11, 12) results in fusion of the viral and host-cell membranes. Due to its inherent instability, the preF protein has the propensity to prematurely trigger into postF, both in solution and on the viral surface (13). Recently, stabilization of preF has been achieved by protein engineering (14, 15), and stabilized preF has been shown to induce higher titers of neutralizing antibodies than postF in animal models (15).

Despite the importance of neutralizing antibodies in protection against severe RSV disease, our understanding of the human antibody response to RSV has been limited to studies of human sera and a small number of RSV-specific human monoclonal antibodies (16-19). The epitopes recognized by these human antibodies, as well as several murine antibodies, have defined at least four 'antigenic sites' on RSV F (1, 10, 16, 18-20) (see also, e.g., Table 1). Three of these sites—I, II, and IV—are present on both pre- and postF, whereas antigenic site Ø exists exclusively on preF. Additional preF-specific epitopes have been defined by antibodies MPE8 (17) and AM14 (21). Although serum mapping studies have shown that site Ø-directed antibodies are responsible for a large proportion of the neutralizing antibody response in most individuals (8), there are additional antibody specificities that contribute to serum neutralizing activity that remain to be defined. In addition, it was heretofore unknown whether certain antibody sequence features are required for recognition of certain neutralizing sites, as observed for other viral targets (22-25). Accordingly, understanding the relationship between neutralization potency and epitope specificity would be advantageous in the selection and/or design of vaccine antigens, as well as therapeutic and/or prophylactic antibodies, which induce potent neutralizing responses to RSV.

While treatment options for established RSV disease are limited, more severe forms of the disease of the lower respiratory tract often require considerable supportive care, including administration of humidified oxygen and respiratory assistance (Fields et al., eds, 1990, Fields Virology, 2$^{nd}$ ed., Vol. 1, Raven Press, New York at pages 1045-1072).

Ribavirin, which is the only drug approved for treatment of infection, has been shown to be effective in the treatment of pneumonia and bronchiolitis associated with RSV infection, and has been shown to modify the course of severe RSV disease in immunocompetent children (Smith et ai., 1991, New Engl. J. Med. 325:24-29). The use of ribavirin is limited due to concerns surrounding its potential risk to pregnant women who may be exposed to the aerosolized drug while it is being administered in a hospital environment.

Similarly, while a vaccine may be useful, no commercially available vaccine has been developed to date. Several vaccine candidates have been abandoned and others are under development (Murphy et al., 1994, Virus Res. 32: 13-36). The development of a vaccine has proven to be problematic. In particular, immunization would be required in the immediate neonatal period since the peak incidence of lower respiratory tract disease occurs at 2-5 months of age. However, it is known that the neonatal immune response is immature at that time. Plus, the infant at that point in time still has high titers of maternally acquired RSV antibody, which might reduce vaccine immunogenicity (Murphy et al., 1988, J. Virol. 62:3907-3910; and Murphy et al, 1991, Vaccine 9:185-189).

Currently, the only approved approach to prophylaxis of RSV disease is passive immunization. For example, the humanized antibody, palivizumab (SYNAGIS®), which is specific for an epitope on the F protein, is approved for intramuscular administration to pediatric patients for prevention of serious lower respiratory tract disease caused by RSV at recommended monthly doses of 15 mg/kg of body weight throughout the RSV season (November through April in the northern hemisphere). SYNAGIS® is a composite of human (95%) and murine (5%) antibody sequences. (Johnson et al, (1997), J. Infect. Diseases 176: 1215-1224 and U.S. Pat. No. 5,824,307).

Although SYNAGIS® has been successfully used for the prevention of RSV infection in pediatric patients, multiple intramuscular doses of 15 mg/kg of SYNAGIS® are required to achieve a prophylactic effect. The necessity for the administration of multiple intramuscular doses of antibody requires repeated visits to the doctor's office, which is not only inconvenient for the patient but can also result in missed doses.

Efforts were made to improve on the therapeutic profile of an anti-RSV-F antibody, and this lead to the identification and development of motavizumab, also referred to as NUMAX™. However, clinical testing revealed that certain of the patients being administered motavizumab were having severe hypersensitivity reactions. Further development of this humanized anti-RSV-F antibody was then discontinued.

Other antibodies to RSV-F protein have been described and can be found in U.S. Pat. Nos. 6,656,467; 5,824,307; 7,786,273; 7,670,600; 7,083,784; 6,818,216; 7,700,735; 7,553,489; 7,323,172; 7,229,619; 7,425,618; 7,740,851; 7,658,921; 7,704,505; 7,635,568; 6,855,493; 6,565,849; 7,582,297; 7,208,162; 7,700,720; 6,413,771; 5,811,524; 6,537,809; 5,762,905; 7,070,786; 7,364,742; 7,879,329; 7,488,477; 7,867,497; 5,534,411; 6,835,372; 7,482,024; 7,691,603; 8,562,996; 8,568,726; 9,447,173; U.S. 20100015596; WO2009088159A1; and WO2014159822. To date, none other than SYNAGIS® has been approved by a regulatory agency for use in preventing an RSV infection.

There remains a need for the provision of highly specific, high affinity, and highly potent neutralizing anti-RSV antibodies and antigen-binding fragments thereof with neutralize at least one, but preferably both, of subtype A and subtype B RSV viral strains, and which preferentially recognize PreF relative to PostF conformations of the F protein. There also remains a need for the provision of anti-RSV and anti-HMPV cross-neutralizing antibodies and antigen-binding fragments thereof.

SUMMARY OF THE INVENTION

Applicant has now discovered, isolated, and characterized, inter alia, an extensive panel of RSV F-specific monoclonal antibodies from the memory B cells of a healthy adult human donor and used these antibodies to comprehensively map the antigenic topology of RSV F. A large proportion of the RSV F-specific human antibody repertoire was advantageously comprised of antibodies with greatly enhanced specificity for the PreF conformation of the F protein (relative to the PostF form), many if not most of which exhibited remarkable potency in neutralization assays against one or both of RSV subtype A and RSV subtype B strains. Indeed, a large number of these antibodies display neutralization potencies that are multiple-fold greater—some 5- to 100-fold greater or more—to previous anti-RSV therapeutic antibodies, such as D25 and pavlizumamab thus serve as attractive therapeutic and/or prophylactic candidates for treating and/or preventing RSV infection and disease.

The most potent antibodies were found to target two distinct antigenic sites that are located near the apex of the preF trimer, providing strong support for the development of therapeutic and/or prophylactic antibodies targeting these antigenic sites, as well as preF-based vaccine candidates that preserve these antigenic sites. Furthermore, the neutralizing antibodies described and disclosed herein represent new opportunities for the prevention of severe RSV disease using passive immunoprophylaxis.

Given the role that the F protein plays in fusion of the virus with the cell and in cell to cell transmission of the virus, the antibodies and pharmaceutical compositions described herein provide a method of inhibiting that process and as such, may be used for preventing infection of a patient exposed to, or at risk for acquiring an infection with RSV, or for treating and/or ameliorating one or more symptoms associated with RSV infection in a patient exposed to, or at risk for acquiring an infection with RSV, or suffering from infection with RSV. The antibodies described herein may also be used to prevent or to treat an RSV infection in a patient who may experience a more severe form of the RSV infection due to an underlying or pre-existing medical condition. A patient who may benefit from treatment with an antibody and/or a pharmaceutical composition of the invention may be a pre-term infant, a full-term infant born during RSV season (approximately late fall (November) through early spring (April)) that is at risk because of other pre-existing or underlying medical conditions including congenital heart disease or chronic lung disease, a child greater than one year of age with or without an underlying medical condition, an institutionalized or hospitalized patient, or an elderly adult (>65 years of age) with or without an underlying medical condition, such as congestive heart failure (CHF), or chronic obstructive pulmonary disease (COPD). A patient who may benefit from such therapy may suffer from a medical condition resulting from a compromised pulmonary, cardiovascular, neuromuscular, or immune system. For example, the patient may suffer from an abnormality of the airway, or an airway malfunction, a chronic lung disease, a chronic or congenital heart disease, a neuromuscular disease that compromises the handling of respiratory secretions, or the patient may be immunosuppressed due to severe combined immunodeficiency disease or severe acquired immunodeficiency disease, or from any other underlying infectious disease or cancerous condition that results in immunosuppression, or the patient may be immunosuppressed due to treatment with an immunosuppressive drug (e.g. any drug used for treating a transplant patient) or radiation therapy. A patient who may benefit from the antibodies and/or pharmaceutical compositions of the invention may be a patient that suffers from chronic obstructive pulmonary disease (COPD), cystic fibrosis (CF), bronchopulmonary dysplasia, congestive heart failure (CHF), or congenital heart disease.

Because the inventive antibodies and antigen-binding fragments thereof are more effective at neutralization of RSV compared to known antibodies, lower doses of the antibodies or antibody fragments or pharmaceutical composition of the invention could be used to achieve a greater level of protection against infection with RSV, and more effective treatment and/or amelioration of symptoms associated with an RSV infection. Accordingly, the use of lower doses of antibodies or fragments thereof which immunospecifically bind to RSV-F antigen may result in fewer or less severe adverse events. Likewise, the use of more effective neutralizing antibodies may result in a diminished need for frequent administration of the antibodies or antibody fragments or pharmaceutical compositions than previously envisioned as necessary for the prevention of infection, or for virus neutralization, or for treatment or amelioration of one or more symptoms associated with an RSV infection. Symptoms of RSV infection may include a bluish skin color due to lack of oxygen (hypoxia), breathing difficulty (rapid breathing or shortness of breath), cough, croupy cough ("seal bark" cough), fever, nasal flaring, nasal congestion (stuffy nose), apnea, decreased appetite, dehydration, poor feeding, altered mental status, or wheezing.

Such antibodies or pharmaceutical compositions may be useful when administered prophylactically (prior to exposure to the virus and infection with the virus) to lessen the severity, or duration of a primary infection with RSV, or ameliorate at least one symptom associated with the infection. The antibodies or pharmaceutical compositions may be used alone or in conjunction with a second agent useful for treating an RSV infection. In certain embodiments, the antibodies or pharmaceutical compositions may be given therapeutically (after exposure to and infection with the virus) either alone, or in conjunction with a second agent to lessen the severity or duration of the primary infection, or to ameliorate at least one symptom associated with the infection. In certain embodiments, the antibodies or pharmaceutical compositions may be used prophylactically as stand-alone therapy to protect patients who are at risk for acquiring an infection with RSV, such as those described above. Any of these patient populations may benefit from treatment with the antibodies of the invention, when given alone or in conjunction with a second agent, including for example, an anti-viral therapy, such as ribavirin, or other anti-viral vaccines.

The antibodies of the invention can be full-length (for example, an IgG1 or IgG4 antibody) or may comprise only an antigen-binding portion (for example, a Fab, F(ab')$_2$ or scFv fragment), and may be modified to affect functionality, e.g., to eliminate residual effector functions (Reddy et al., (2000), J. Immunol. 164:1925-1933).

Accordingly, in certain embodiments are provided isolated antibodies or antigen-binding fragments thereof that specifically bind to Respiratory Syncytial Virus (RSV) F protein (F), wherein at least one, at least two, at least three, at least four, at least five, or at least six of the CDRH1, a CDRH2, a CDRH3, a CDRL1, a CDRL2, and CDRL3 amino acid sequence such antibodies or the antigen-binding fragments thereof are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to at least one, at least two, at least three, at least four, at least five, or at least six the CDRH1, a CDRH2, a CDRH3, a CDRL1, a CDRL2, and/or a CDRL3 amino acid sequences as disclosed in Table 6 of an antibody selected from Antibody Number 124 through Antibody Number 244 as disclosed in Table 6; and wherein said antibody or the antigen-binding fragment thereof also has one or more of the following characteristics: a) the antibodies or antigen-binding fragments thereof cross-compete with said antibodies or antigen-binding fragments thereof for binding to RSV-F; b) the antibodies or antigen-binding fragments thereof display better binding affinity for the PreF form of RSV-F relative to the PostF form; c) the antibodies or antigen-binding fragments thereof display a clean or low polyreactivity profile; d) the antibodies or antigen-binding fragments thereof display neutralization activity toward RSV subtype A and RSV subtype B in vitro; e) the antibodies or antigen-binding fragments thereof display antigenic site specificity for RSV-F at Site Ø, Site I, Site II, Site III, Site IV, or Site V f) the antibodies or antigen-binding fragments thereof display antigenic site specificity for RSV-F Site Ø, Site V, or Site III relative to RSV-F Site I, Site II, or Site IV; g) at least a portion of the epitope with which the antibodies or antigen-binding fragments thereof interact comprises the α3 helix and β3/β4 hairpin of PreF; h) the antibodies or antigen-binding fragments thereof display an in vitro neutralization potency (IC$_{50}$) of between about 0.5 microgram/milliliter (μg/ml) to about 5 μg/ml; between about 0.05 μg/ml to about 0.5 μg/ml; or less than about 0.05 mg/ml; i) the binding affinities and/or epitopic specificities of the antibodies or antigen-binding fragments thereof for any one of the RSV-F variants designated as 1, 2, 3, 4, 5, 6, 7, 8, 9, and DG in FIG. 7A is reduced or eliminated relative to the binding affinities and/or epitopic specificities of said antibodies or antigen-binding fragments thereof for the RSV-F or RSV-F DS-Cav1; j) the antibodies or antigen-binding fragments thereof display a cross-neutralization potency (IC$_{50}$) against human metapneumovirus (HMPV); k) the antibodies or antigen-binding fragments thereof do not complete with D25, MPEG, palivizumab, or motavizumab; or 1) the antibodies or antigen-binding fragments thereof display at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC50) than D25 and/or palivizumab.

In certain other embodiments, the isolated antibodies or antigen-binding fragments thereof comprise: at least two; at least three; at least 4; at least 5; at least 6; at least 7; at least 8; at least 9; at least 10; at least 11; or at least 12; of characteristics a) through 1) above.

In certain other embodiments, the isolated antibodies or antigen-binding fragments thereof comprise: a) the CDRH3 amino acid sequence of any one of the antibodies designated Antibody Number 124 through Antibody Number 244 as disclosed in Table 6; b) the CDRH2 amino acid sequence of any one of the antibodies designated Antibody Number 124 through Antibody Number 244 as disclosed in Table 6; c) the CDRH1 amino acid sequence of any one of the antibodies designated Antibody Number 124 through Antibody Number 244 as disclosed in Table 6; d) the CDRL3 amino acid sequence of any one of the antibodies designated Antibody Number 124 through Antibody Number 244 as disclosed in Table 6; e) the CDRL2 amino acid sequence of any one of the antibodies designated Antibody Number 124 through Antibody Number 244 as disclosed in Table 6; f) the CDRL1 amino acid sequence of any one of the antibodies designated Antibody Number 124 through Antibody Number 244 as disclosed in Table 6; or g) any combination of two or more of a), b), c), d), e), and f).

In certain other embodiments, the isolated antibodies or antigen-binding fragments thereof comprise: a) a heavy chain (HC) amino acid sequence of any one of the antibodies designated Antibody Number 124 through Antibody Number 244 as disclosed in Table 6; and/or b) a light chain (LC) amino acid sequence of any one of the antibodies designated Antibody Number 124 through Antibody Number 244 as disclosed in Table 6.

In certain other embodiments, the isolated antibodies or antigen-binding fragments thereof are selected from the group consisting of antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 124 through Antibody Number 244 as disclosed in Table 6.

In certain other embodiments, the isolated antibodies or antigen-binding fragments thereof are selected from the group consisting of the antibodies designated as Antibody Number 124 through Antibody Number 244 as disclosed in Table 6.

In other embodiments are provided isolated nucleic acid sequences encoding antibodies, or antigen-binding fragments thereof, or light and/or heavy chains thereof according to any of the other embodiments disclosed herein.

In other embodiments are provided expression vectors comprising isolated nucleic acid sequences according to other embodiments disclosed herein.

In other embodiments are provided host cells transfected, transformed, or transduced with nucleic acid sequences or expression vectors according to other embodiments disclosed herein.

In other embodiments are provided pharmaceutical compositions comprising: one or more of the isolated antibodies or antigen-binding fragments thereof according to other embodiments disclosed herein; and a pharmaceutically acceptable carrier and/or excipient.

In other embodiments are provided pharmaceutical compositions: one or more nucleic acid sequences according other embodiments disclosed herein; or one or more of the expression vectors according to other embodiments disclosed herein; and a pharmaceutically acceptable carrier and/or excipient.

In other embodiments are provided transgenic organisms comprising nucleic acid sequences according to other embodiments disclosed herein; or expression vectors according to other embodiments disclosed herein.

In other embodiments are provided methods of treating or preventing a Respiratory Syncytial Virus (RSV) infection, or at least one symptom associated with RSV infection, comprising administering to a patient in need there of or suspected of being in need thereof: a) one or more antibodies or antigen-binding fragments thereof according to other embodiments disclosed herein; b) nucleic acid sequences according to other embodiments disclosed herein; an expression vector according to other embodiments disclosed herein; a host cell according to other embodiments disclosed herein; or e) a pharmaceutical composition according to other embodiments disclosed herein; such that the RSV infection is treated or prevented, or the at least on symptom associated with RSV infection is treated, alleviated, or reduced in severity.

In other embodiments are provided methods of treating or preventing either a Respiratory Syncytial Virus (RSV) infection and/or a human metapneumovirus (HMPV) infection, or at least one symptom associated with said RSV infection or said HMPV infection, comprising administering to a patient in need thereof or suspected of being in need thereof: a) one or more antibodies or antigen-binding fragments thereof according to other embodiments disclosed herein; b) a nucleic acid sequences according to other embodiments disclosed herein; c) an expression vector according to other embodiments disclosed herein; d) a host cell according to other embodiments disclosed herein; or e) a pharmaceutical composition according to other embodiments disclosed herein; such that the RSV infection is treated or prevented, or the at least on symptom associated with RSV infection is treated, alleviated, or reduced in severity. In other embodiments are provided methods according to other embodiments wherein the one or more antibodies or antigen-binding fragments thereof of a) is selected from the group consisting of the antibodies desifgnated as Antibody Number 179, 188, 211, 221, or 229 as disclosed in Table 6.

In other embodiments are provided methods according to other embodiments wherein the method further comprises administering to the patient a second therapeutic agent.

In other embodiments are provided methods according to other embodiments, wherein the second therapeutic agent is selected group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

In certain embodiments are provided pharmaceutical compositions comprising any one or more of the isolated antibodies or antigen-binding fragments thereof and a pharmaceutically acceptable carrier and/or excipient.

In certain embodiments are provided pharmaceutical compositions according to other embodiments for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

In certain embodiments are provided pharmaceutical compositions according to other embodiments for use in treating or preventing either a Respiratory Syncytial Virus (RSV) infection and/or a human metapneumovirus (HMPV) infection, or at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

In certain other embodiments are provided uses of the pharmaceutical compositions according to other embodiments in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

In certain other embodiments are provided uses of the pharmaceutical compositions according to other embodiments in the manufacture of a medicament for preventing either a Respiratory Syncytial Virus (RSV) infection and/or a human metapneumovirus (HMPV) infection, or at least one symptom associated with said RSV infection and/or said HMPV infection, in a patient in need thereof or suspected of being in need thereof, wherein the infection is either prevented, or at least one symptom or complication associated with the infection is prevented, ameliorated, or lessened in severity and/or duration as a result of such use.

BRIEF DESCRIPTION OF THE FIGURES

FIGS. 1A-1F illustrate the anti-RSV repertoire cloning and sequence analysis of the identified and isolated antibodies. FIG. 1A: RSV F-specific B cell sorting. FACS plots show RSV F reactivity of IgG+ and IgA+ B cells from the healthy adult human donor. B cells in quadrant 2 (Q2) were single cell sorted. FIG. 1B: Isotype analysis. Index sort plots show the percentage of RSV F-specific B cells that express IgG or IgA. FIG. 1C: Clonal lineage analysis. Each slice represents one clonal lineage; the size of the slice is proportional to the number of clones in the lineage. The total number of clones is shown in the center of the pie. Clonal lineages were assigned based on the following criteria: 1) matching of variable and joining gene segments; 2) identical CDR3 loop lengths; and 3) >80% homology in CDR3 nucleotide sequences. FIG. 1D: VH repertoire analysis. VH germline genes were considered to be enriched in the RSV repertoire if a given gene was found to be enriched by greater than 3-fold over non-RSV-specific repertoires (33). FIG. 1E: CDRH3 length distribution. FIG. 1F: Somatic hypermutation in VH (excluding CDRH3). Red bar indicates the average number of nucleotide substitutions. Each clonal lineage is only represented once in FIG. 1D and FIG. 1E. Data for non-RSV reactive IgGs were derived from published sequences obtained by high-throughput sequencing of re-arranged antibody variable gene repertoires from healthy individuals (33).

FIGS. 2A-2D illustrate the similar antibody preferences observed for conformational state and subtype of RSV F in the repertoire. FIG. 2A: IgG affinities for preF and postF are plotted as shown. FIG. 2B: Percentage of antibodies within the donor repertoire that recognized both conformations of F (green) or bind only to preF (blue) or postF (orange). FIG. 2C: Percentage of antibodies within the donor repertoire that bind specifically to subtype A (green), subtype B (blue), or both subtypes A and B (red). N.B., non-binder. IgG KDs were calculated for antibodies with BLI responses >0.1 nm. Antibodies with BLI responses <0.05 nm were designated as N.B. FIG. 2D: Polyreactivity analysis of anti-RSV antibodies. The polyreactivity of the isolated anti-RSV F antibodies was measured using a previously described assay (42, 43). Three panels of control antibodies were included for comparison: a group of 138 antibodies currently in clinical trials, 39 antibodies that have been approved for clinical use and 14 broadly neutralizing HIV antibodies.

FIG. 3A: The previously determined structure of preF with one protomer shown as ribbons and with six antigenic sites rainbow colored from red to purple. FIG. 3B: The percentage of antibodies targeting each antigenic site is shown. FIG. 3C: Percentage of preF-specific antibodies targeting each antigenic site. FIG. 3D: Apparent antibody binding affinities for subtype A PreF antigenic sites. FIG. 3E: Apparent binding affinities for subtype A postF antigenic sites. FIG. 3F: Apparent antibody binding affinities for subtype B PreF antigenic sites. FIG. 3G. Apparent binding affinities for subtype B postF. Only antibodies with apparent binding affinities greater than 2 nM were included in this analysis, since antibodies with lower affinity could not be reliably mapped. Red bars show the median and the dotted grey line is at 2 nM. N.B., non-binder.

FIGS. 4A-4G illustrate neutralizing potencies of anti-RSV antibodies and correlation between potency and Pref vs. PostF specificity for each of RSV subtypes A and B. FIG. 4A: Neutralization $IC_{50}$s for the antibodies isolated from the donor repertoire. Data points are colored based on neutralization potency, according to the legend on the right. Red and blue dotted lines depict motavizumab and D25 $IC_{50}$s, respectively. FIG. 4B: Percentage of neutralizing antibodies in the donor repertoire against RSV subtype A or subtype B, stratified by potency as indicated in the legend in the right portion of the figure. FIG. 4C: Percentage of antibodies within the donor repertoire that neutralized both RSV subtypes A and B (red) or neutralized only RSV subtype A (green) or subtype B (blue). FIG. 4D: Apparent binding affinities for subtype A, preF and postF, plotted for each antibody (IgG KDs were calculated for antibodies with BLI responses >0.1 nm. Antibodies with BLI responses <0.05 nm were designated as N.B.) FIG. 4E: Neutralization $IC_{50}$s plotted for RSV subtype A preF-specific, postF-specific, and cross-reactive antibodies. (Red and blue dotted lines depict motavizumab and D25 $IC_{50}$s, respectively. Red bars depict median. N.B., non-binder; N.N., non-neutralizing). FIG. 4F: Apparent antibody binding affinities for subtype B, preF and postF. FIG. 4G: $IC_{50}$s plotted for RSV subtype B preF-specific, postF-specific and cross-reactive antibodies. (Black bar depicts median. N.B., non-binder; N.N., non-neutralizing.)

FIG. 5A: apparent preF $K_D$ plotted against neutralization $IC_{50}$ and colored according to antigenic site, as shown in the legend at right of FIG. 5C. FIG. 5B: apparent postF $K_D$ plotted against neutralization $IC_{50}$ and colored as in FIG. 5A. FIG. 5C: antibodies grouped according to neutralization potency and colored by antigenic site as in legend at right. N.B., non-binder; N.N., non-neutralizing. IgG $K_D$s were calculated for antibodies with BLI responses >0.1 nm. Antibodies with BLI responses <0.05 nm were designated as N.B. Statistical significance was determined using an unpaired two-tailed t test. The Pearson's correlation coefficient, r, was calculated using Prism software version 7.0. Antibodies that failed to bind or neutralize were excluded from the statistical analysis due to the inability to accurately calculate midpoint concentrations.

FIG. 6A: Schematic of fluorescent prefusion RSV F probe shows one PE-conjugated streptavidin molecule bound by four avi-tagged trimeric prefusion F molecules. FIG. 6B: Coomassie-stained SDS-PAGE gel demonstrating the isolation of RSV F with a single AviTag per trimer using sequential Ni-NTA and Strep-Tactin purifications, as described in the Methods. FIG. 6C: Fluorescence size-exclusion chromatography (FSEC) trace of the tetrameric probes on a Superose 6 column. Positions of molecular weight standards are indicated with arrows.

FIGS. 7A-7C illustrate the generation and validation of preF patch panel mutants. FIG. 7A: Panel of RSV F variants used for epitope mapping. FIG. 7B: Prefusion RSV F shown as molecular surface with one protomer colored in white. The nine variants, each containing a patch of mutations, are uniquely colored according to the table in FIG. 7A. FIG. 7C: Binding of each IgG to fluorescently labeled beads coupled to each of the variants listed in FIG. 7A was measured using PE-conjugated anti-human Fc antibody on a FLEXMAP 3D flow cytometer (Luminex). Reduced binding of D25 and motavizumab to patches 1 and 5, respectively, is consistent with their structurally defined epitopes (10, 11). AM14 binding was reduced for both patch 3 and patch 9, due to its unique protomer-spanning epitope (21). This characteristic binding profile was used to assist in the classification of other possible quaternary-specific antibodies in the panel.

FIG. 10A: Subtype B preF affinity plotted against neutralization $IC_{50}$ for all antibodies and colored by antigenic site according to the colore scheme depicted in FIG. 10C, right portion. FIG. 10B: PostF affinity plotted against $IC_{50}$ and colored as in FIG. 10A. FIG. 10C: Antibodies with preF affinities higher than 2 nM grouped according to neutralization potency and colored by antigenic site (right portion).

DETAILED DESCRIPTION OF THE INVENTION

Figure 1A:
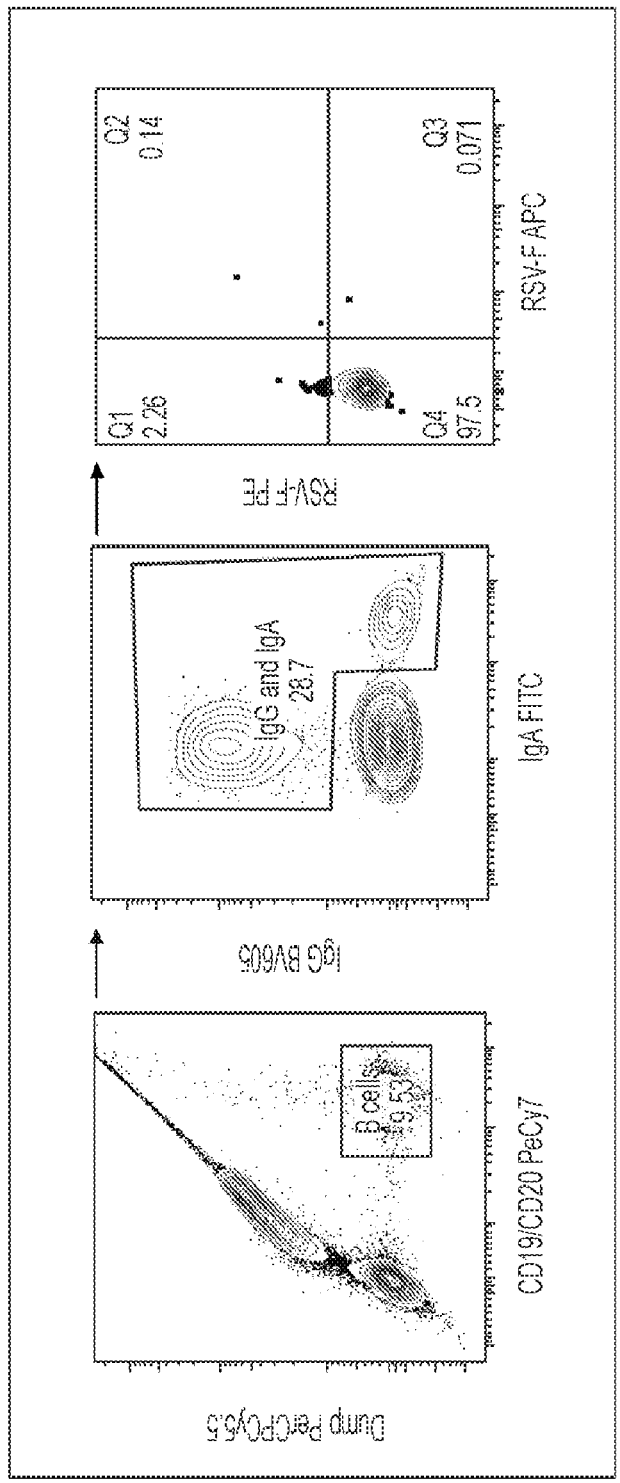

Unless defined otherwise, all technical and scientific terms used herein have the same meaning as commonly understood by one of ordinary skill in the art to which this invention belongs. As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

Definitions

"Respiratory Syncytial Virus-F protein", also referred to as "RSV-F" or "RSV F" is a type I transmembrane surface protein, which has an N terminal cleaved signal peptide and a membrane anchor near the C terminus (Collins, P. L. et al., (1984), PNAS (USA) 81:7683-7687). The RSV-F protein is synthesized as an inactive 67 KDa precursor denoted as F0 (Calder, L. J.; et al., Virology (2000), 277,122-131. The F0 protein is activated proteolytically in the Golgi complex by a furin-like protease at two sites, yielding two disulfide linked polypeptides, F2 and F1, from the N and C terminal, respectively. There is a 27 amino acid peptide released called "pep27". There are furin cleavage sites (FCS) on either side of the pep27 (Collins, P. L.; Mottet, G. (1991), J. Gen. Virol., 72: 3095-3101; Sugrue, R. J., et al. (2001), J. Gen. Virol., 82, 1375-1386). The F2 subunit consists of the Heptad repeat C (HRC), while the F1 contains the fusion polypeptide (FP), heptad repeat A (HRA), domain I, domain II, heptad repeat B (HRB), transmembrane (™) and cytoplasmic domain (CP) (See Sun, Z. et al. Viruses (2013), 5:21 1-225). The RSV-F protein plays a role in fusion of the virus particle to the cell membrane, and is expressed on the surface of infected cells, thus playing a role in cell to cell transmission of the virus and syncytia formation. The amino acid sequence of the RSV-F protein is provided in GenBank as accession number AAX23994.

A stabilized variant of the PreF trimeric conformation of RSV-F, termed "RSV-DS-Cav1", or "DS-Cav1" disclosed in, inter alia, Stewart-Jones et al., PLos One, Vol. 10(6) e0128779 and WO 2011/050168 was used in the identification, isolation, and characterization of the antibodies disclosed herein.

The term "laboratory strain" as used herein refers to a strain of RSV (subtype A or B) that has been passaged extensively in in vitro cell culture. A "laboratory strain" can acquire adaptive mutations that may affect their biological properties. A "clinical strain" as used herein refers to an RSV isolate (subtype A or B), which is obtained from an infected individual and which has been isolated and grown in tissue culture at low passage.

The term "effective dose 99" or "$ED_{99}$" refers to the dosage of an agent that produces a desired effect of 99% reduction of viral forming plaques relative to the isotype (negative) control. In the present invention, the $ED_{99}$ refers to the dosage of the anti-RSV-F antibodies that will neutralize the virus infection (i.e., reduce 99% of viral load) in vivo, as described in Example 5.

The term "$IC_{50}$" refers to the "half maximal inhibitory concentration", which value measures the effectiveness of compound (e.g. anti-RSV-F antibody) inhibition towards a biological or biochemical utility. This quantitative measure indicates the quantity required for a particular inhibitor to inhibit a given biological process by half In certain embodiments, RSV virus neutralization potencies for anti-RSV and/or anti-RSV/anti-HMPV cross-neutralizing antibodies disclosed herein are expressed as neutralization $IC_{50}$ values.

"Palivizumab", also referred to as "SYNAGIS®", is a humanized anti-RSV-F antibody with heavy and light chain variable domains having the amino acid sequences as set forth in U.S. Pat. Nos. 7,635,568, 5,824,307. This antibody, which immunospecifically binds to the RSV-F protein, is currently FDA-approved for the passive immunoprophylaxis of serious RSV disease in high-risk children and is administered intramuscularly at recommended monthly doses of 15 mg/kg of body weight throughout the RSV season (November through April in the northern hemisphere). SYNAGIS® is composed of 95% human and 5% murine antibody sequences. See also Johnson et al., (1997), J. Infect. Diseases 176:1215-1224.

"Motavizumab", also referred to as "NUMAX™", is an enhanced potency RSV-F-specific humanized monoclonal antibody derived by in vitro affinity maturation of the complementarity-determining regions of the heavy and light chains of palivizumab. For reference purposes, the amino acid sequence of the NUMAX™ antibody is disclosed in U.S. Patent Publication 2003/0091584 and in U.S. Pat. No. 6,818,216 and in Wu et al., (2005) J. Mol. Bio. 350(1):126-144 and in Wu, et al. (2007) J. Mol. Biol. 368:652-665. It is also shown herein as SEQ ID NO: 359 for the heavy chain and as SEQ ID NO: 360 for the light chain of the antibody.

As used herein, the terms "treat," "treatment" and "treating" refer to the reduction or amelioration of the progression, severity, and/or duration of an upper and/or lower respiratory tract RSV infection and/or human metapneumovirus (HMPV), otitis media, or a symptom or respiratory condition related thereto (such as asthma, wheezing, or a combination thereof) resulting from the administration of one or more therapies (including, but not limited to, the administration of one or more prophylactic or therapeutic agents). In certain embodiments, such terms refer to the reduction or inhibition of the replication of RSV and/or HMPV, the inhibition or reduction in the spread of RSV and/or HMPV to other tissues or subjects (e.g., the spread to the lower respiratory tract), the inhibition or reduction of infection of a cell with a RSV and/or HMPV, or the amelioration of one or more symptoms associated with an upper and/or lower respiratory tract RSV infection or otitis media.

As used herein, the terms "prevent," "preventing," and "prevention" refer to the prevention or inhibition of the development or onset of an upper and/or lower respiratory tract RSV and/or HMPV infection, otitis media or a respiratory condition related thereto in a subject, the prevention or inhibition of the progression of an upper respiratory tract RSV and/or HMPV infection to a lower respiratory tract RSV and/or HMPV infection, otitis media or a respiratory condition related thereto resulting from the administration of a therapy (e.g., a prophylactic or therapeutic agent), the prevention of a symptom of an upper and/or lower tract RSV and/or HMPV infection, otitis media or a respiratory condition related thereto, or the administration of a combination of therapies (e.g., a combination of prophylactic or therapeutic agents). As used herein, the terms "ameliorate" and "alleviate" refer to a reduction or diminishment in the severity a condition or any symptoms thereof.

The term "antibody", as used herein, is intended to refer to immunoglobulin molecules comprised of four polypeptide chains, two heavy (H) chains and two light (L) chains interconnected by disulfide bonds (i.e., "full antibody molecules"), as well as multimers thereof (e.g. IgM) or antigen-binding fragments thereof. Each heavy chain (HC) is comprised of a heavy chain variable region ("HCVR" or "$V_H$") and a heavy chain constant region (comprised of domains $C_H1$, $C_H2$ and $C_H3$). Each light chain (LC) is comprised of a light chain variable region ("LCVR or "$V_L$") and a light chain constant region (CO. The $V_H$ and $V_L$ regions can be further subdivided into regions of hypervariability, termed complementarity determining regions (CDRs), interspersed with regions that are more conserved, termed framework regions (FRs). Each $V_H$ and $V_L$ is composed of three CDRs and four FRs, arranged from amino-terminus to carboxy-terminus in the following order: FR1, CDR1, FR2, CDR2, FR3, CDR3, FR4. In certain embodiments of the invention, the FRs of the antibody (or antigen binding fragment thereof) may be identical to the human germline sequences, or may be naturally or artificially modified. An amino acid consensus sequence may be defined based on a side-by-side analysis of two or more CDRs. Accordingly, the CDRs in a heavy chain are designated "CHRH1", "CDRH2", and "CDRH3", respectively, and the CDRs in a light chain are designated "CDRL1", "CDRL2", and "CDRL3".

Substitution of one or more CDR residues or omission of one or more CDRs is also possible. Antibodies have been described in the scientific literature in which one or two CDRs can be dispensed with for binding. Padlan et al. (1995 FASEB J. 9:133-139) analyzed the contact regions between antibodies and their antigens, based on published crystal structures, and concluded that only about one fifth to one third of CDR residues actually contact the antigen. Padlan also found many antibodies in which one or two CDRs had no amino acids in contact with an antigen (see also, Vaj dos et al. 2002 J Mol Biol 320:415-428).

CDR residues not contacting antigen can be identified based on previous studies (for example residues H60-H65 in CDRH2 are often not required), from regions of Kabat CDRs lying outside Chothia CDRs, by molecular modeling and/or empirically. If a CDR or residue(s) thereof is omitted, it is usually substituted with an amino acid occupying the corresponding position in another human antibody sequence or a consensus of such sequences. Positions for substitution within CDRs and amino acids to substitute can also be selected empirically.

The fully human monoclonal antibodies disclosed herein may comprise one or more amino acid substitutions, insertions and/or deletions in the framework and/or CDR regions of the heavy and light chain variable domains as compared to the corresponding germline sequences. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes fully monoclonal antibodies comprising variants of any of the CDR amino acid sequences disclosed herein having one or more conservative substitutions. For example, the present invention includes antibodies having CDR amino acid sequences with, e.g., 10 or fewer, 8 or fewer, 6 or fewer, 4 or fewer, etc. conservative amino acid substitutions relative to any of the CDR amino acid sequences disclosed herein.

The term "human antibody", as used herein, is intended to include antibodies having variable and constant regions derived from human germline immunoglobulin sequences. The human mAbs of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include mAbs in which CDR sequences derived from the germline of another mammalian species (e.g., mouse), have been grafted onto human FR sequences.

The term "humanized antibody" refers to human antibody in which one or more CDRs of such antibody have been replaced with one or more corresponding CDRs obtained a non-human derived (e.g., mouse, rat, rabbit, primate) antibody. Humanized antibodies may also include certain non-CDR sequences or residues derived from such non-human antibodies as well as the one or more non-human CDR sequence. Such antibodies may also be referred to as "chimeric" antibodies.

The term "recombinant" generally refers to any protein, polypeptide, or cell expressing a gene of interest that is produced by genetic engineering methods. The term "recombinant" as used with respect to a protein or polypeptide, means a polypeptide produced by expression of a recombinant polynucleotide. The proteins used in the immunogenic compositions of the invention may be isolated from a natural source or produced by genetic engineering methods.

The antibodies of the invention may, in some embodiments, be recombinant human antibodies. The term "recombinant human antibody", as used herein, is intended to include all antibodies, including human or humanized antibodies, that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

The term "specifically binds," or "binds specifically to", or the like, means that an antibody or antigen-binding fragment thereof forms a complex with an antigen that is relatively stable under physiologic conditions. Specific binding can be characterized by an equilibrium dissociation constant of at least about $1\times10^{-6}$ M or less (e.g., a smaller $K_D$ denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIACORE™, biolayer interferometry measurements using, e.g., a ForteBio Octet HTX instrument (Pall Life Sciences), which bind specifically to RSV-F. Moreover, multi-specific antibodies that bind to RSV-F protein and one or more additional antigens, such as an antigen expressed by HMPV, or a bi-specific that binds to two different regions of RSV-F are nonetheless considered antibodies that "specifically bind", as used herein. In certain embodiments, the antibodies disclosed herein display equilibrium dissociation constants (and hence specificities) of about $1\times10^{-6}$M; about $1\times10^{-7}$ M; about $1\times10^{-8}$M; about $1\times10^{-9}$ M; about $1\times10^{-10}$ M; between about $1\times10^{-6}$M and about $1\times10^{-7}$ M; between about $1\times10^{-7}$M and about $1\times10^{-8}$ M; between about $1\times10^{-8}$ M and about $1\times10^{-9}$ M; or between about $1\times10^{-9}$ M and about $1\times10^{-10}$ M.

The term "high affinity" antibody refers to those mAbs having a binding affinity to RSV-F and/or HMPV, expressed as $K_D$, of at least $10^{-9}$M; more preferably $10^{-10}$M, more preferably $10^{-11}$M, more preferably $10^{-12}$M as measured by surface plasmon resonance, e.g., BIACORE™, biolayer interferometry measurements using, e.g., a ForteBio Octet HTX instrument (Pall Life Sciences), or solution-affinity ELISA.

By the term "slow off rate", "Koff" or "kd" is meant an antibody that dissociates from RSV-F, with a rate constant of $1\times10^{-3}$ s$^{-1}$ or less, preferably $1\times10^{-4}$ s$^{-1}$ or less, as determined by surface plasmon resonance, e.g., BIACORE™ or a ForteBio Octet HTX instrument (Pall Life Sciences).

The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. In certain embodiments, the terms "antigen-binding portion" of an antibody, or "antibody fragment", as used herein, refers to one or more fragments of an antibody that retains the ability to bind to RSV-F and/or HMPV.

An antibody fragment may include a Fab fragment, a F(ab')$_2$ fragment, a Fv fragment, a dAb fragment, a fragment containing a CDR, or an isolated CDR. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and (optionally) constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_h1$-$C_h2$; (v) $V_H$-$C_h1$-$C_h2$-$C_h3$; (vi) $V_H$-$C_H2$-$C_H3$; (vii) $V_H$-$C_L$; $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be mono-specific or multi-specific (e.g., bi-specific). A multi-specific antigen-binding fragment of an antibody will typically comprise at least two different variable domains, wherein each variable domain is capable of specifically binding to a separate antigen or to a different epitope on the same antigen. Any multi-specific antibody format, including the exemplary bi-specific antibody formats disclosed herein, may be adapted for use in the context of an antigen-binding fragment of an antibody of the present invention using routine techniques available in the art.

The specific embodiments, antibody or antibody fragments of the invention may be conjugated to a therapeutic moiety ("immunoconjugate"), such as an antibiotic, a second anti-RSV-F antibody, an anti-HMPV antibody, a vaccine, or a toxoid, or any other therapeutic moiety useful for treating an RSV infection and/or an HMPV infection.

An "isolated antibody", as used herein, is intended to refer to an antibody that is substantially free of other antibodies (Abs) having different antigenic specificities (e.g., an isolated antibody that specifically binds RSV-F and/or HMPV, or a fragment thereof, is substantially free of Abs that specifically bind antigens other than RSV-F and/or HMPV.

A "blocking antibody" or a "neutralizing antibody", as used herein (or an "antibody that neutralizes RSV-F and/or HMPV activity"), is intended to refer to an antibody whose binding to RSV-F or to an HMPV antigen, as the case may be as disclosed herein, results in inhibition of at least one biological activity of RSV-F and/or HMPV. For example, an antibody of the invention may aid in blocking the fusion of RSV and/or HMPV to a host cell, or prevent syncytia formation, or prevent the primary disease caused by RSV and/or HMPV. Alternatively, an antibody of the invention may demonstrate the ability to ameliorate at least one symptom of the RSV infection and or HMPV infection. This inhibition of the biological activity of RSV-F and/or HMPV can be assessed by measuring one or more indicators of RSV-F and/or HMPV biological activity by one or more of several standard in vitro assays (such as a neutralization assay, as described herein) or in vivo assays known in the art (for example, animal models to look at protection from challenge with RSV and/or HMPV following administration of one or more of the antibodies described herein).

The term "surface plasmon resonance", as used herein, refers to an optical phenomenon that allows for the analysis of real-time biomolecular interactions by detection of alterations in protein concentrations within a biosensor matrix, for example using the BIACORE™ system (Pharmacia Biosensor AB, Uppsala, Sweden and Piscataway, N.J.).

The term "$K_D$", as used herein, is intended to refer to the equilibrium dissociation constant of a particular antibody-antigen interaction.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The term "substantial identity", or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. Accordingly, nucleic acid sequences that display a certain percentage "identity" share that percentage identity, and/or are that percentage "identical" to one another. A nucleic acid molecule having substantial identity to a reference nucleic acid molecule may, in certain instances, encode a polypeptide having the same or substantially similar amino acid sequence as the polypeptide encoded by the reference nucleic acid molecule.

In certain embodiments, the disclosed antibody nucleic acid sequences are, e.g., at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to other sequences and/or share such percentage identities with one another (or with certain subsets of the herein-disclosed antibody sequences).

As applied to polypeptides, the term "substantial identity" or "substantially identical" means that two peptide sequences, when optimally aligned, such as by the programs GAP or BESTFIT using default gap weights, share at least 90% sequence identity, even more preferably at least 95%, 98% or 99% sequence identity. Accordingly, amino acid sequences that display a certain percentage "identity" share that percentage identity, and/or are that percentage "identical" to one another. Accordingly, amino acid sequences that display a certain percentage "identity" share that percentage identity, and/or are that percentage "identical" to one another.

In certain embodiments, the disclosed antibody amino acid sequences are, e.g., at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to other sequences and/or share such percentage identities with one another (or with certain subsets of the herein-disclosed antibody sequences).

Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. (See, e.g., Pearson (1994) Methods Mol. Biol. 24: 307-331). Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions and other modifications, including conservative amino acid substitutions. For instance, GCG software contains programs such as GAP and BESTFIT which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA {e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. (See, e.g., Altschul et al. (1990) J. Mol. Biol. 215: 403 410 and (1997) Nucleic Acids Res. 25:3389 402).

In certain embodiments, the antibody or antibody fragment for use in the method of the invention may be monospecific, bi-specific, or multi-specific. Multi-specific antibodies may be specific for different epitopes of one target polypeptide or may contain antigen-binding domains specific for epitopes of more than one target polypeptide. An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise an Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 mAbs; N44S, K52N, and V82I (IMGT; N384S, K392N, and V422I by EU) in the case of IgG2 mAbs; and Q15R, N44S, K52N, V57M, R69K, E79Q, and V82I (by IMGT; Q355R, N384S, K392N, V397M, R409K, E419Q, and V422I by EU) in the case of IgG4 mAbs. Variations on the bi-specific antibody format described above are contemplated within the scope of the present invention.

By the phrase "therapeutically effective amount" is meant an amount that produces the desired effect for which it is administered. The exact amount will depend on the purpose of the treatment, and will be ascertainable by one skilled in the art using known techniques (see, for example, Lloyd (1999) The Art, Science and Technology of Pharmaceutical Compounding).

An "immunogenic composition" relates to a composition containing an antigen/immunogen, e.g. a microorganism, such as a virus or a bacterium, or a component thereof, a protein, a polypeptide, a fragment of a protein or polypeptide, a whole cell inactivated, subunit or attenuated virus, or a polysaccharide, or combination thereof, administered to stimulate the recipient's humoral and/or cellular immune systems to one or more of the antigens/immunogens present in the immunogenic composition. The immunogenic compositions of the present invention can be used to treat a human susceptible to RSV and/or HMPV infection or suspected of having or being susceptible to RSV and/or HMPV infection, by means of administering the immunogenic compositions via a systemic route. These administrations can include injection via the intramuscular (i.m.), intradermal (i.d.), intranasal or inhalation route, or subcutaneous (s.c.) routes; application by a patch or other transdermal delivery device. In one embodiment, the immunogenic composition may be used in the manufacture of a vaccine or in the elicitation of polyclonal or monoclonal antibodies that could be used to passively protect or treat a mammal.

The terms "vaccine" or "vaccine composition", which are used interchangeably, refer to a composition comprising at least one immunogenic composition that induces an immune response in an animal.

In certain embodiments, a protein of interest comprises an antigen. The terms "antigen," "immunogen," "antigenic," "immunogenic," "antigenically active," and "immunologically active" when made in reference to a molecule, refer to any substance that is capable of inducing a specific humoral and/or cell-mediated immune response. In one embodiment, the antigen comprises an epitope, as defined above.

"Immunologically protective amount", as used herein, is an amount of an antigen effective to induce an immunogenic response in the recipient that is adequate to prevent or ameliorate signs or symptoms of disease, including adverse health effects or complications thereof. Either humoral immunity or cell-mediated immunity or both can be induced. The immunogenic response of an animal to a composition can be evaluated, e.g., indirectly through measurement of antibody titers, lymphocyte proliferation assays, or directly through monitoring signs and symptoms after challenge with the microorganism. The protective immunity conferred by an immunogenic composition or vaccine can be evaluated by measuring, e.g., reduction of shed of challenge organisms, reduction in clinical signs such as mortality, morbidity, temperature, and overall physical condition, health and performance of the subject. The immune response can comprise, without limitation, induction of cellular and/or humoral immunity. The amount of a composition or vaccine that is therapeutically effective can vary, depending on the particular organism used, or the condition of the animal being treated or vaccinated.

An "immune response", or "immunological response" as used herein, in a subject refers to the development of a humoral immune response, a cellular-immune response, or a humoral and a cellular immune response to an antigen/immunogen. A "humoral immune response" refers to one that is at least in part mediated by antibodies. A "cellular immune response" is one mediated by T-lymphocytes or other white blood cells or both, and includes the production of cytokines, chemokines and similar molecules produced by activated T-cells, white blood cells, or both. Immune responses can be determined using standard immunoassays and neutralization assays, which are known in the art.

"Immunogenicity", as used herein, refers to the capability of a protein or polypeptide to elicit an immune response directed specifically against a bacteria or virus that causes the identified disease.

Unless specifically indicated otherwise, the term "antibody," as used herein, shall be understood to encompass antibody molecules comprising two immunoglobulin heavy chains and two immunoglobulin light chains (i.e., "full antibody molecules") as well as antigen-binding fragments thereof. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex.

Preparation of Human Antibodies

As disclosed herein, anti-RSV and or anti-RSV/anti-HMPF cross neutralizing antibodies by be obtained through B cell sorting techniques available to the artisan, and, for example, as described in the EXAMPLES below. Methods for generating human antibodies in transgenic mice are also known in the art and may be employed in order to derive antibodies in accordance with the present disclosure. Any such known methods can be used in the context of the present invention to make human antibodies that specifically bind to RSV-F (see, for example, U.S. Pat. No. 6,596,541).

In certain embodiments, the antibodies of the instant invention possess affinities ($K_D$) ranging from about $1.0 \times 10^{-7}$M to about $1.0 \times 10^{-12}$M, when measured by binding to antigen either immobilized on solid phase or in solution phase. In certain embodiments, the antibodies of the invention possess affinities ($K_D$) ranging from about $1 \times 10^{-7}$ M to about $6 \times 10^{-10}$M, when measured by binding to antigen either immobilized on solid phase or in solution phase. In certain embodiments, the antibodies of the invention possess affinities ($K_D$) ranging from about $1 \times 10^{-7}$ M to about $9 \times 10^{-10}$ M, when measured by binding to antigen either immobilized on solid phase or in solution phase.

The anti-RSV-F and/or anti-HMPV antibodies and antibody fragments disclosed herein encompass proteins having amino acid sequences that vary from those of the described antibodies, but that retain the ability to bind RSV-F. Such variant antibodies and antibody fragments comprise one or more additions, deletions, or substitutions of amino acids when compared to parent sequence, but exhibit biological activity that is essentially equivalent to that of the described antibodies. Likewise, the antibody-encoding DNA sequences of the present invention encompass sequences that comprise one or more additions, deletions, or substitutions of nucleotides when compared to the disclosed sequence, but that encode an antibody or antibody fragment that is essentially bioequivalent to an antibody or antibody fragment of the invention.

Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antibodies will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and/or in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antibody.

Bioequivalent variants of the antibodies of the invention may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antibodies may include antibody variants comprising amino acid changes, which modify the glycosylation characteristics of the antibodies, e.g., mutations that eliminate or remove glycosylation.

Biological and Biophysical Characteristics of the Antibodies

In certain embodiments, the inventive antibodies and antigen-binding fragments thereof specifically bind to Respiratory Syncytial Virus (RSV) F protein (F), wherein at least one of the CDRH1, CDRH2, CDRH3, CDRL1, CDRL2, and/or CDRL3 amino acid sequences of such antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical, or 100% identical; and/or all percentages of identity in between; to at least one of the CDRH1, a CDRH2, a CDRH3, a CDRL1, a CDRL2, and/or a CDRL3 amino acid sequences as disclosed in Table 6 of an antibody selected from Antibody Number 124 through Antibody Number 244 as disclosed in Table 6. In certain embodiments, such antibodies also possess at least one, two, three, four, five, six, seven, eight, nine, ten, or more characteristics disclosed in the immediately following eleven paragraphs.

Without wishing to be bound by any theory, it is believed that the inventive antibodies and antigen-binding fragments thereof may function by binding to RSV-F, preferably in the PreF conformation, and in so doing act to block the fusion of the viral membrane with the host cell membrane. The antibodies of the present invention may also function by binding to RSV-F and in so doing block the cell to cell spread of the virus and block syncytia formation associated with RSV infection of cells. Advantageously, both RSV subtype A and RSV subtype B are effectively blocked, or neutralized, by the majority of the anti-RSV antibodies disclosed herein.

In certain embodiments, the inventive antibodies and antigen-binding fragment thereof display better binding affinity for the PreF form of RSV-F relative to the PostF form of RSV-F.

In certain other embodiments, the inventive antibodies and antigen-binding fragments thereof advantageously display a clean or low polyreactivity profile (see, e.g., WO 2014/179363 and Xu et al., *Protein Eng Des Sel, Oct; 26*(10):663-70), and are thus particularly amenable to development as safe, efficacious, and developable therapeutic and/or prophylactic anti-RSV and/or HMPV treatments.

In certain embodiments, the inventive antibodies and antigen-binding fragments thereof, without wishing to be bound by any theory, may function by blocking or inhibiting RSV fusion to the cell membrane by binding to any one or more of, e.g., antigenic Sites Ø, I, II, III, IV, or Site V of the PreF conformation of the F protein. In certain embodiments, the inventive antibodies display antigenic site specificity for Site Ø, Site V, or Site III of PreF relative to RSV-F Site I, Site II, or Site IV.

In certain embodiments, at least a portion of the epitope with which the inventive antibodies and antigen-binding fragments thereof interacts comprises a portion of the α3 helix and β3/β4 hairpin of PreF. In certain embodiments, substantially all of the epitope of such antibodies comprises the α3 helix and β3/β4 hairpin of PreF. In still further embodiments, the inventive antibodies cross-copmpete with antibodies that recognize a portion or substantially allof the α3 helix and β3/β4 hairpin of PreF.

In certain embodiments, the inventive antibodies and antigen-binding fragments thereof display an in vitro neutralization potency ($IC_{50}$) of between about 0.5 microgram/milliliter (µg/ml) to about 5 µg/ml; between about 0.05 µg/ml to about 0.5 µg/ml; or less than about 0.05 mg/ml.

In certain embodiments, the binding affinity and/or epitopic specificity of the inventive antibodies and antigen-binding fragments thereof for any one of the RSV-F variants designated as 1, 2, 3, 4, 5, 6, 7, 8, 9, and DG in FIG. 7A is reduced or eliminated relative to the binding affinity and/or epitopic specificity of said antibody or antigen-binding fragment thereof for the RSV-F or RSV-F DS-Cav1.

In certain embodiments, the inventive antibodies and antigen-binding fragments thereof display a cross-neutralization potency ($IC_{50}$) against human metapneumovirus (HMPV) as well as RSV. In certain such embodiments, the inventive antibodies and antigen-binding fragments thereof comprise at least one of the CDRH1, CDRH2, CDRH3, CDRL1, CDRL2, and/or CDRL3 amino acid sequences of such antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; or 100% identical; and/or all percentages of identity in between; to at least one of the CDRH1, a CDRH2, a CDRH3, a CDRL1, a CDRL2, and/or a CDRL3 amino acid sequences as disclosed in Table 6 of an antibody selected from the group consisting of Antibody Number 179, 188, 211, 221, and 229 as disclosed in Table 6.

In certain embodiments, the inventive antibodies and antigen-binding fragments thereof do not complete with D25, MPE8, palivisumab, motavizumab, or AM-14. In certain embodiments, the inventive antibodies and antigen-binding fragments thereof do not complete with D25, MPE8, palivisumab, or motavizumab. In certain embodiments, the inventive antibodies and antigen-binding fragments thereof do not complete with MPE8, palivisumab, or motavizumab. In certain embodiments, the inventive antibodies and antigen-binding fragments thereof do not complete with D25, palivisumab, or motavizumab. In certain embodiments, the inventive antibodies and antigen-binding fragments thereof do not complete with D25. In certain embodiments, the inventive antibodies and antigen-binding fragments thereof do not complete with MPE8. In certain embodiments, the inventive antibodies and antigen-binding fragments thereof do not complete with palivisumab. In certain embodiments, the inventive antibodies and antigen-binding fragments thereof do not complete with motavizumab.

In certain embodiments, the inventive antibodies and antigen-binding fragments thereof complete with one or more of D25, MPEG, palivisumab, motavizumab, and/or AM-14.

In certain embodiments, the inventive antibodies and antigen-binding fragments thereof display at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC50) than D25 and/or palivizumab.

In certain embodiments, the inventive antibodies and antigen-binding fragments thereof comprise the CDRH3 amino acid sequence of any one of the antibodies designated Antibody Number 124 through Antibody Number 244 as disclosed in Table 6.

In certain embodiments, the inventive antibodies and antigen-binding fragments thereof comprise the CDRH2 amino acid sequence of any one of the antibodies designated Antibody Number 124 through Antibody Number 244 as disclosed in Table 6.

In certain embodiments, the inventive antibodies and antigen-binding fragments thereof comprise the CDRH1 amino acid sequence of any one of the antibodies designated Antibody Number 124 through Antibody Number 244 as disclosed in Table 6.

In certain embodiments, the inventive antibodies and antigen-binding fragments thereof comprise the CDRL3 amino acid sequence of any one of the antibodies designated Antibody Number 124 through Antibody Number 244 as disclosed in Table 6.

In certain embodiments, the inventive antibodies and antigen-binding fragments thereof comprise the CDRL2 amino acid sequence of any one of the antibodies designated Antibody Number 124 through Antibody Number 244 as disclosed in Table 6.

In certain embodiments, the inventive antibodies and antigen-binding fragments thereof comprise the CDRL1 amino acid sequence of any one of the antibodies designated Antibody Number 124 through Antibody Number 244 as disclosed in Table 6.

In certain embodiments, the inventive antibodies and antigen-binding fragments thereof comprise any combination of two, three, four, five, or six characteristics disclosed in the immediately preceeding six paragraphs.

In certain embodiments, the inventive antibodies and antigen-binding fragments thereof comprise a heavy chain (HC) amino acid sequence of any one of the antibodies designated Antibody Number 124 through Antibody Number 244 as disclosed in Table 6. In certain embodiments, the inventive antibodies and antigen-binding fragments thereof comprise a light chain (LC) amino acid sequence of any one of the antibodies designated Antibody Number 124 through Antibody Number 244 as disclosed in Table 6. In certain embodiments, the inventive antibodies and antigen-binding fragments thereof comprise a heavy chain (HC) amino acid sequence and a light chain (LC) amino acid sequence of any one of the antibodies designated Antibody Number 124 through Antibody Number 244 as disclosed in Table 6.

In certain embodiments, the inventive antibodies and antigen-binding fragments thereof are each selected from the group consisting antibodies that are at least 70% identical; at least 75% identical; 80% identical; at least 85% identical; at least 90% identical; at least 95% identical; at least 96% identical; at least 97% identical; at least 98% identical; at least 99% identical; 100% identical; and/or all percentages of identity in between; to any one of the antibodies designated as Antibody Number 124 through Antibody Number 244 as disclosed in Table 6.

In certain embodiments, the inventive antibodies and antigen-binding fragments thereof comprise are each selected from the group consisting of the antibodies designated as Antibody Number 124 through Antibody Number 244 as disclosed in Table 6.

In certain embodiments, isolated nucleic acid sequences are provided that encode antibodies or antigen binding fragments thereof that specifically bind to Respiratory Syncytial Virus (RSV) F protein and antigen-binding fragments thereof, wherein at least one of the CDRH1, CDRH2, CDRH3, CDRL1, CDRL2, and/or CDRL3 amino acid sequences of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; 100% identical; and/or all percentages of identity in between; to at least one the CDRH1, CDRH2, CDRH3, CDRL1, CDRL2, and/or CDRL3 amino acid sequences as disclosed in Table 6 of an antibody selected from Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH3 amino acid sequence of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH2 amino acid sequences of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH1 amino acid sequences of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL3 amino acid sequences of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL2 amino acid sequences of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL1 amino acid sequences of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the heavy chain (HC) amino acid sequences of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the heavy chain (LC) amino acid sequences of the antibodies designated Antibody Number 124 through Antibody Number 244 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences are each selected from the group consisting of sequences that are at least 70% identical; at least 75% identical; 80% identical; at least 85% identical; at least 90% identical; at least 95% identical; at least 96% identical; at least 97% identical; at least 98% identical; at least 99% identical; 100% identical; and/or all percentages of identity in between; to any one of the nucleic acid seuences that are disclosed in Table 6, and compliments thereof.

In certain embodiments, expression vectors are provided comprising the isolated nucleic acid sequences disclose herein and throughout, and in particular in the immedivately preceeding ten paragraphs.

In certain embodiments, host cells transfected, transformed, or transduced with the nucleic acid sequences and/or the expression vectors disclosed immediately above are provided.

Epitope Mapping and Related Technologies

As described above and as demonstrated in the EXAMPLES, Applicant has characterized the epitopic specificities, bin assignments, and antigenic site assignments of the inventive antibodies and antigen-binding fragments thereof. In addition to the methods for conducting such characterization, various other techniques are available to the artisan that can be used to carry out such characterization or to otherwise ascertain whether an antibody "interacts with one or more amino acids" within a polypeptide or protein. Exemplary techniques include, for example, a routine cross-blocking assay such as that described Antibodies, Harlow and Lane (Cold Spring Harbor Press, Cold Spring Harb., N.Y.) can be performed. Other methods include alanine scanning mutational analysis, peptide blot analysis (Reineke (2004) Methods Mol Biol 248:443-63), peptide cleavage analysis crystallographic studies and NMR analysis. In addition, methods such as epitope excision, epitope extraction and chemical modification of antigens can be employed (Tomer (2000) Protein Science 9: 487-496). Another method that can be used to identify the amino acids within a polypeptide with which an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water and exchangeable protons within amino acids that are protected by the antibody complex undergo deuterium-to-hydrogen back-exchange at a slower rate than exchangeable protons within amino acids that are not part of the interface. As a result, amino acids that form part of the protein/antibody interface may retain deuterium and therefore exhibit relatively higher mass compared to amino acids not included in the interface. After dissociation of the antibody, the target protein is subjected to protease cleavage and mass spectrometry analysis, thereby revealing the deuterium-labeled residues that correspond to the specific amino acids with which the antibody interacts. See, e.g., Ehring (1999) Analytical Biochemistry 267 (2):252-259; Engen and Smith (2001) Anal. Chem. 73:256A-265A.

As the artisan will understand, an epitope can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, and more usually, at least 5 or 8-10 amino acids in a unique spatial conformation.

Modification-Assisted Profiling (MAP), also known as Antigen Structure-based Antibody Profiling (ASAP) is a method that categorizes large numbers of monoclonal antibodies (mAbs) directed against the same antigen according to the similarities of the binding profile of each antibody to chemically or enzymatically modified antigen surfaces (U.S. Publ. No. 2004/0101920). Each category may reflect a unique epitope either distinctly different from or partially overlapping with epitope represented by another category. This technology allows rapid filtering of genetically identical antibodies, such that characterization can be focused on genetically distinct antibodies. When applied to hybridoma screening, MAP may facilitate identification of rare hybridoma clones that produce mAbs having the desired characteristics. MAP may be used to sort the antibodies of the invention into groups of antibodies binding different epitopes.

In certain embodiments, the inventive antibodies and/or antigen-binding fragments thereof interact with an amino acid sequence comprising the amino acid residues that are altered in one or more of the F protein patch variants disclosed, e.g., in the EXAMPLES and which are depicted in, e.g., FIG. 7A and which are designated as RSV F Variants 1, 2, 3, 4, 5, 6, 7, 8, 9, and DG. In certain embodiments, such inventive antibodies and antigen-binding fragments thereof interact with an amino acid sequence comprising the amino acid residues that are altered in RSV F Variant 2. In certain embodiments, the inventive antibodies and/or antigen-binding fragments thereof interact with amino acid residues that extend beyond the region(s) identified above by about 5 to 10 amino acid residues, or by about 10 to 15 amino acid residues, or by about 15 to 20 amino acid residues towards either the amino terminal or the carboxy terminal of the RSV-F protein.

In certain embodiments, the antibodies of the present invention do not bind to the same epitope on RSV-F protein as palivizumab, motavizumab, MPE8, or AM-14.

As the artisan understands, one can easily determine whether an antibody binds to the same epitope as, or competes for binding with, a reference anti-RSV-F antibody by using routine methods available in the art. For example, to determine if a test antibody binds to the same epitope as a reference RSV-F antibody of the invention, the reference antibody is allowed to bind to a RSV-F protein or peptide under saturating conditions. Next, the ability of a test antibody to bind to the RSV-F molecule is assessed. If the test antibody is able to bind to RSV-F following saturation binding with the reference anti-RSV-F antibody, it can be concluded that the test antibody binds to a different epitope than the reference anti-RSV-F antibody. On the other hand, if the test antibody is not able to bind to the RSV-F molecule following saturation binding with the reference anti-RSV-F antibody, then the test antibody may bind to the same epitope as the epitope bound by the reference anti-RSV-F antibody of the invention.

To determine if an antibody competes for binding with a reference anti-RSV-F antibody, the above-described binding methodology is performed in two orientations: In a first orientation, the reference antibody is allowed to bind to a RSV-F molecule under saturating conditions followed by assessment of binding of the test antibody to the RSV-F molecule. In a second orientation, the test antibody is allowed to bind to a RSV-F molecule under saturating conditions followed by assessment of binding of the reference antibody to the RSV-F molecule. If, in both orientations, only the first (saturating) antibody is capable of binding to the RSV-F molecule, then it is concluded that the test antibody and the reference antibody compete for binding to RSV-F. As will be appreciated by a person of ordinary skill in the art, an antibody that competes for binding with a reference antibody may not necessarily bind to the identical epitope as the reference antibody, but may sterically block binding of the reference antibody by binding an overlapping or adjacent epitope.

Two antibodies bind to the same or overlapping epitope if each competitively inhibits (blocks) binding of the other to the antigen. That is, a 1-, 5-, 10-, 20- or 100-fold excess of one antibody inhibits binding of the other by at least 50% but preferably 75%, 90% or even 99% as measured in a competitive binding assay (see, e.g., Junghans et al., Cancer Res. (1990) 50:1495-1502). Alternatively, two antibodies have the same epitope if essentially all amino acid mutations in the antigen that reduce or eliminate binding of one antibody reduce or eliminate binding of the other. Two antibodies have overlapping epitopes if some amino acid mutations that reduce or eliminate binding of one antibody reduce or eliminate binding of the other.

Additional routine experimentation (e.g., peptide mutation and binding analyses) can then be carried out to confirm whether the observed lack of binding of the test antibody is in fact due to binding to the same epitope as the reference antibody or if steric blocking (or another phenomenon) is responsible for the lack of observed binding. Experiments of this sort can be performed using ELISA, RIA, surface plasmon resonance, flow cytometry or any other quantitative or qualitative antibody-binding assay available in the art.

Immunoconjugates

The invention encompasses a human RSV-F monoclonal antibody conjugated to a therapeutic moiety ("immunoconjugate"), such as an agent that is capable of reducing the severity of primary infection with RSV and/or HMPV, or to ameliorate at least one symptom associated with RSV infection and/or HMPV infection, including coughing, fever, pneumonia, or the severity thereof. Such an agent may be a second different antibody to RSV-F and/or HMPV, or a vaccine. The type of therapeutic moiety that may be conjugated to the anti-RSV-F antibody and/or anti-HMPV antibody and will take into account the condition to be treated and the desired therapeutic effect to be achieved. Alternatively, if the desired therapeutic effect is to treat the sequelae or symptoms associated with RSV and/or HMPV infection, or any other condition resulting from such infection, such as, but not limited to, pneumonia, it may be advantageous to conjugate an agent appropriate to treat the sequelae or symptoms of the condition, or to alleviate any side effects of the antibodies of the invention. Examples of suitable agents for forming immunoconjugates are known in the art, see for example, WO 05/103081.

Multi-Specific Antibodies

The antibodies of the present invention may be mono-specific, bi-specific, or multi-specific. Multi-specific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The antibodies of the present invention can be linked to or co-expressed with another functional molecule, e.g., another peptide or protein. For example, an antibody or fragment thereof can be functionally linked {e.g., by chemical coupling, genetic fusion, noncovalent association or otherwise) to one or more other molecular entities, such as another antibody or antibody fragment to produce a bi-specific or a multi-specific antibody with a second binding specificity.

An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). Further modifications that may be found within the second $C_{H3}$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies. Variations on the bi-specific antibody format described above are contemplated within the scope of the present invention.

Therapeutic Administration and Formulations

The invention provides therapeutic compositions comprising the inventive anti-RSV-F antibodies or antigen-binding fragments thereof. The administration of therapeutic compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of each of the antibodies of the invention may vary depending upon the age and the size of a subject to be administered, target disease, conditions, route of administration, and the like. When the antibodies of the present invention are used for treating a RSV infection and/or HMPV infection in a patient, or for treating one or more symptoms associated with a RSV infection and/or HMPV infection, such as the cough or pneumonia associated with a RSV infection and/or HMPV in a patient, or for lessening the severity of the disease, it is advantageous to administer each of the antibodies of the present invention intravenously or subcutaneously normally at a single dose of about 0.01 to about 30 mg/kg body weight, more preferably about 0.1 to about 20 mg/kg body weight, or about 0.1 to about 15 mg/kg body weight, or about 0.02 to about 7 mg/kg body weight, about 0.03 to about 5 mg/kg body weight, or about 0.05 to about 3 mg/kg body weight, or about 1 mg/kg body weight, or about 3.0 mg/kg body weight, or about 10 mg/kg body weight, or about 20 mg/kg body weight. Multiple doses may be administered as necessary. Depending on the severity of the condition, the frequency and the duration of the treatment can be adjusted. In certain embodiments, the antibodies or antigen-binding fragments thereof of the invention can be administered as an initial dose of at least about 0.1 mg to about 800 mg, about 1 to about 600 mg, about 5 to about 300 mg, or about 10 to about 150 mg, to about 100 mg, or to about 50 mg. In certain embodiments, the initial dose may be followed by administration of a second or a plurality of subsequent doses of the antibodies or antigen-binding fragments thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural and oral routes. The composition may be administered by any convenient route, for example by infusion or bolus injection, by absorption through epithelial or mucocutaneous linings {e.g., oral mucosa, nasal mucosa, rectal and intestinal mucosa, etc.) and may be administered together with other biologically active agents. Administration can be systemic or local. It may be delivered as an aerosolized formulation (See US Publ. No. 2011/031 1515 and U.S. Publ. No. 2012/ 0128669). The delivery of agents useful for treating respiratory diseases by inhalation is becoming more widely accepted (See A. J. Bitonti and J. A. Dumont, (2006), Adv. Drug Deliv. Rev, 58:1 106-118). In addition to being effective at treating local pulmonary disease, such a delivery mechanism may also be useful for systemic delivery of antibodies (See Maillet et al. (2008), Pharmaceutical Research, Vol. 25, No. 6, 2008).

The pharmaceutical composition can be also delivered in a vesicle, in particular a liposome (see, for example, Langer (1990) Science 249:1527-1533).

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUIIVIALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™ OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L.P.) and the HUMIRA™ Pen (Abbott Labs, Abbott Park, Ill.), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Administration Regimens

According to certain embodiments, multiple doses of an antibody to RSV-F and/or HMPV may be administered to a subject over a defined time course. The methods according to this aspect of the invention comprise sequentially administering to a subject multiple doses of an antibody to RSV-F and/or HMPV. As used herein, "sequentially administering" means that each dose of antibody to RSV-F and/or HMPV is administered to the subject at a different point in time, e.g., on different days separated by a predetermined interval (e.g., hours, days, weeks or months). The present invention includes methods which comprise sequentially administering to the patient a single initial dose of an antibody to RSV-F and/or HMPV, followed by one or more secondary doses of the antibody to RSV-F and/or HMPV and optionally followed by one or more tertiary doses of the antibody to RSV-F and/or HMPV.

The terms "initial dose," "secondary doses," and "tertiary doses," refer to the temporal sequence of administration of the antibody to RSV-F and/or HMPV. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of antibody to RSV-F and/or HMPV, but generally may differ from one another in terms of frequency of administration. In certain embodiments, however, the amount of antibody to RSV-F and/or HMPV contained in the initial, secondary and/or tertiary doses vary from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g.,1,1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of antibody to RSV-F and/or HMPV which is administered to a patient prior to the administration of the very next dose in the sequence with no intervening doses.

The methods according to this aspect of the invention may comprise administering to a patient any number of secondary and/or tertiary doses of an antibody to RSV-F and/or HMPV. For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Accordingly, in certain embodiments are provided pharmaceutical compositions comprising: one or more of the inventive antibodies or antigen-binding fragments thereof disclosed herein and throughout and a pharmaceutically acceptable carrier and/or one or more excipients. In certain other embodiments are provided pharmaceutical compositions comprising: one or more nucleic acid sequences encoding one or more inventive antibodies or antigen-binding fragments thereof; or one or more the expression vectors harboring such nucleic acid sequences; and a pharmaceutically acceptable carrier and/or one or more excipients.

Therapeutic Uses of the Antibodies

Due to their binding to and interaction with the RSV fusion protein (RSV-F), it is believed that the inventive antibodies and antigen-binding fragments thereof are useful—without wishing to be bound to any theory—for preventing fusion of the virus with the host cell membrane, for preventing cell to cell virus spread, and for inhibition of syncytia formation. Additionally, as Applicant has demonstrated herein that, surprisingly, a subset of the inventive anti-RSV antibodies and antigen-binding fragment thereof display cross-neutralizing potency against HMPV, the inventive antibodies and antigen-binding fragments thereof are advantageous for preventing an infection of a subject with RSV and/or HMPV when administered prophylactically. Alternatively, the antibodies of the present invention may be useful for ameliorating at least one symptom associated with the infection, such as coughing, fever, pneumonia, or for lessening the severity, duration, and/or frequency of the infection. The antibodies of the invention are also contemplated for prophylactic use in patients at risk for developing or acquiring an RSV infection and/or HMPV infection. These patients include pre-term infants, full term infants born during RSV season (late fall to early spring), the elderly (for example, in anyone 65 years of age or older) and/or HMPV season, or patients immunocompromised due to illness or treatment with immunosuppressive therapeutics, or patients who may have an underlying medical condition that predisposes them to an RSV infection (for example, cystic fibrosis patients, patients with congestive heart failure or other cardiac conditions, patients with airway impairment, patients with COPD) and/or HMPV infection. It is contemplated that the antibodies of the invention may be used alone, or in conjunction with a second agent, or third agent for treating RSV infection and/or HMPV infection, or for alleviating at least one symptom or complication associated with the RSV infection and/or HMPV infection, such as the fever, coughing, bronchiolitis, or pneumonia associated with, or resulting from such an infection. The second or third agents may be delivered concurrently with the antibodies of the invention, or they may be administered separately, either before or after the antibodies of the invention.

The second or third agent may be an anti-viral such as ribavirin, an NSAID or other agents to reduce fever or pain, another second but different antibody that specifically binds RSV-F, an agent (e.g. an antibody) that binds to another RSV antigen, such as RSV-G, a vaccine against RSV, an siRNA specific for an RSV antigen.

In yet a further embodiment of the invention the present antibodies are used for the preparation of a pharmaceutical composition for treating patients suffering from a RSV infection and/or HMPV infection. In yet another embodiment of the invention the present antibodies are used for the preparation of a pharmaceutical composition for reducing the severity of a primary infection with RSV and/or HMPV, or for reducing the duration of the infection, or for reducing at least one symptom associated with the RSV infection and/or the HMPV infection. In a further embodiment of the invention the present antibodies are used as adjunct therapy with any other agent useful for treating an RSV infection and/or and HMPV infectin, including an antiviral, a toxoid, a vaccine, a second RSV-F antibody, or any other antibody specific for an RSV antigen, including an RSV-G antibody, or any other palliative therapy known to those skilled in the art.

Accordingly, in certain embodiments are provided methods of treating or preventing a Respiratory Syncytial Virus (RSV) infection, or at least one symptom associated with RSV infection, comprising administering to a patient in need thereof or suspected of being in need thereof one or more of the inventive antibodies or antigen-binding fragments thereof disclosed herein and throughout, such as, e.g., one or more of the anti-RSV antibodies disclosed in Table 6, such that the RSV infection is treated or prevented, or the at least on symptom associated with RSV infection is treated, alleviated, or reduced in severity.

In certain other embodiments are provided methods of treating or preventing a Respiratory Syncytial Virus (RSV) infection, or at least one symptom associated with RSV infection, comprising administering to a patient in need thereof or suspected of being in need thereof a nucleic acid sequence encoding one or more of the inventive antibodies or antigen-binding fragments thereof, such as nucleic acid sequences disclosed in Table 6 and compliments thereof, such that the RSV infection is treated or prevented, or the at least on symptom associated with RSV infection is treated, alleviated, or reduced in severity.

In additional embodiments are provided methods of treating or preventing a Respiratory Syncytial Virus (RSV) infection, or at least one symptom associated with RSV infection, comprising administering to a patient in need thereof or suspected of being in need thereof a host cell harboring a nucleic acid sequence or an expression vector comprising such a nucleic aci sequence, wherein such nucleic acid sequences is selected from the group consisiting of sequences disclosed in Table 6 and compliments thereof, such that the RSV infection is treated or prevented, or the at least on symptom associated with RSV infection is treated, alleviated, or reduced in severity.

In additional embodiments are provided methods of treating or preventing a Respiratory Syncytial Virus (RSV) infection, or at least one symptom associated with RSV infection, comprising administering to a patient in need thereof or suspected of being in need thereof a pharmaceutical composition comprising either: one or more of the inventive antibodies or antigen-binding fragments thereof as disclosed in Table 6; one or more nucleic acid sequences or an expression vectors comprising such a nucleic acid sequence, wherein such nucleic acid sequences are selected from the group consisting of sequences disclosed in Table 6 and compliments thereof; one or more host cells harboring one or more nucleic acid sequences or an expression vectors comprising such one or more nucleic acid sequences, wherein such nucleic acid sequences are selected from the group consisting of sequences disclosed in Table 6 and compliments thereof; and a pharmaceutically acceptable carrier and/or one or more excipients, such that the RSV infection is treated or prevented, or the at least one symptom associated with RSV infection is treated, alleviated, or reduced in severity.

In certain embodiments ase provided methods of treating or preventing either a Respiratory Syncytial Virus (RSV) infection or a human metapneumovirus (HMPV) infection, ar at least one symptom associated with said RSV infection or said HMPV infection, comprising administering to a patient in need thereof or suspected of being in need thereof one or more of the inventive antibodies or antigen-binding fragments thereof disclosed herein and throughout, such as, e.g., one or more of the anti-RSV antibodies disclosed in Table 6, such that the RSV infection is treated or prevented, or the at least on symptom associated with RSV infection is treated, alleviated, or reduced in severity. In certain embodiments, the one or more antibodies or antigen-binding fragments thereof of a) is selected from the group consisting of the antibodies designated as Antibody Number 179, 188, 211, 221, or 229 as disclosed in Table 6.

In certain other embodiments are provided methods of treating or preventing either a Respiratory Syncytial Virus (RSV) infection or a human metapneumovirus (HMPV) infection, ar at least one symptom associated with said RSV infection or said HMPV infection, comprising administering to a patient in need thereof or suspected of being in need thereo a nucleic acid sequence encoding one or more of the inventive antibodies or antigen-binding fragments thereof, such nucleic acid sequenced disclosed in Table 6 and compliments thereof, such that the RSV infection is treated or prevented, or the at least on symptom associated with RSV infection is treated, alleviated, or reduced in severity. In certain embodiments, the one or more antibodies or antigen-binding fragments thereof of a) is selected from the group consisting of the antibodies designated as Antibody Number 179, 188, 211, 221, or 229 as disclosed in Table 6.

In additional embodiments are provided methods of treating or preventing either a Respiratory Syncytial Virus (RSV) infection or a human metapneumovirus (HMPV) infection, or at least one symptom associated with said RSV infection or said HMPV infection, comprising administering to a patient in need thereof or suspected of being in need thereof a host cell harboring a nucleic acid sequence or an expression vector comprising such a nucleic acid sequence, wherein such nucleic acid sequences is selected from the group consisting of sequences disclosed in Table 6 and compliments thereof, such that the RSV infection is treated or prevented, or the at least on symptom associated with RSV infection is treated, alleviated, or reduced in severity. In certain embodiments, the one or more antibodies or antigen-binding fragments thereof of is selected from the group consisting of the antibodies designated as Antibody Number 179, 188, 211, 221, or 229 as disclosed in Table 6.

In additional embodiments are provided methods of treating or preventing either a Respiratory Syncytial Virus (RSV) infection or a human metapneumovirus (HMPV) infection, or at least one symptom associated with said RSV infection or said HMPV infection, comprising administering to a patient in need thereof or suspected of being in need thereof a pharmaceutical composition comprising either: one or more of the inventive antibodies or antigen-binding fragments thereof as disclosed in Table 6; one or more nucleic acid sequences or an expression vectors comprising such a nucleic acid sequence, wherein such nucleic acid sequences are selected from the group consisting of sequences disclosed in Table 6 and compliments thereof; one or more host cells harboring one or more nucleic acid sequences or an expression vectors comprising suchone or more nucleic acid sequences, wherein such nucleic acid sequences are selected from the group consisting of sequences disclosed in Table 6 and compliments thereof; and a pharmaceutically acceptable carrier and/or one or more excipients, such that the RSV infection is treated or prevented, or the at least on symptom associated with RSV infection is treated, alleviated, or reduced in severity. In certain embodiments, the one or more antibodies or antigen-binding fragments thereof of a) is selected from the group consisting of the antibodies designated as Antibody Number 179, 188, 211, 221, or 229 as disclosed in Table 6.

Combination Therapies

As noted above, according to certain embodiments, the disclosed methods comprise administering to the subject one or more additional therapeutic agents in combination with an antibody to RSV-F and/or HMPV or a pharmaceutical composition of the invention. As used herein, the expression "in combination with" means that the additional therapeutic agents are administered before, after, or concurrent with an antibody or pharmaceutical composition comprising an anti-RSV-F antibody. The term "in combination with" also includes sequential or concomitant administration of an anti-RSV-F antibody and a second therapeutic agent.

For example, when administered "before" the pharmaceutical composition comprising the anti-RSV-F antibody, the additional therapeutic agent may be administered about 72 hours, about 60 hours, about 48 hours, about 36 hours, about 24 hours, about 12 hours, about 10 hours, about 8 hours, about 6 hours, about 4 hours, about 2 hours, about 1 hour, about 30 minutes, about 15 minutes or about 10 minutes prior to the administration of the pharmaceutical composition comprising the anti-RSV-F antibody. When administered "after" the pharmaceutical composition comprising the anti-RSV-F antibody, the additional therapeutic agent may be administered about 10 minutes, about 15 minutes, about 30 minutes, about 1 hour, about 2 hours, about 4 hours, about 6 hours, about 8 hours, about 10 hours, about 12 hours, about 24 hours, about 36 hours, about 48 hours, about 60 hours or about 72 hours after the administration of the pharmaceutical composition comprising the anti-RSV-F antibodies. Administration "concurrent" or with the pharmaceutical composition comprising the anti-RSV-F antibody means that the additional therapeutic agent is administered to the subject in a separate dosage form within less than 5 minutes (before, after, or at the same time) of administration of the pharmaceutical composition comprising the anti-RSV-F antibody, or administered to the subject as a single combined dosage formulation comprising both the additional therapeutic agent and the anti-RSV-F antibody.

Combination therapies may include an anti-RSV-F antibody of the invention and any additional therapeutic agent that may be advantageously combined with an antibody of the invention, or with a biologically active fragment of an antibody of the invention.

For example, a second or third therapeutic agent may be employed to aid in reducing the viral load in the lungs, such as an antiviral, for example, ribavirin. The antibodies may also be used in conjunction with other therapies, as noted above, including a toxoid, a vaccine specific for RSV, a second antibody specific for RSV-F, or an antibody specific for another RSV antigen, such as RSV-G.

Diagnostic Uses of the Antibodies

The inventive anti-RSV antibodies and antigen-binding fragments thereof may also be used to detect and/or measure RSV and/or HMPV in a sample, e.g., for diagnostic purposes. It is envisioned that confirmation of an infection thought to be caused by RSV and/or HMPV may be made by measuring the presence of the virus through use of any one or more of the antibodies of the invention. Exemplary diagnostic assays for RSV and/or HMPV may comprise, e.g., contacting a sample, obtained from a patient, with an anti-RSV-F and/or HMPV antibody of the invention, wherein the anti-RSV-F and/or HMPV antibody is labeled with a detectable label or reporter molecule or used as a capture ligand to selectively isolate the virus containing the F protein from patient samples. Alternatively, an unlabeled anti-RSV-F and/or HMPV antibody can be used in diagnostic applications in combination with a secondary antibody which is itself detectably labeled. The detectable label or reporter molecule can be a radioisotope, such as $^{3}H$, $^{14}C$, $^{32}P$, $^{35}S$, or $^{125}I$; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure RSV containing the F protein and/or HMPV in a sample include enzyme-linked immunosorbent assay (ELISA), radioimmunoassay (RIA), and fluorescence-activated cell sorting (FACS).

Samples that can be used in RSV and/or HMPV diagnostic assays according to the present invention include any tissue or fluid sample obtainable from a patient, which contains detectable quantities of RSV-F protein and/or HMPV, or fragments thereof, under normal or pathological conditions. Generally, levels of RSV-F and/or HMPV in a particular sample obtained from a healthy patient (e.g., a patient not afflicted with a disease or condition associated with the presence of RSV-F and/or HMPV) will be measured to initially establish a baseline, or standard, level of the F protein from RSV and/or HMPV. This baseline level of RSV-F and/or HMPV can then be compared against the levels of RSV-F and/or HMPV measured in samples obtained from individuals suspected of having an RSV and/or HMPV infection, or symptoms associated with such infection.

EXAMPLES

Applicant has comprehensively profiled the human antibody response to RSV fusion protein (F) by isolating and characterizing 108 RSV F-specific monoclonal antibodies from the memory B cells of a healthy adult donor, and used these antibodies to comprehensively map the antigenic topology of RSV F. The antibody response to RSV F was determined to be comprised of a broad diversity of clones that target several antigenic sites. Nearly half of the most potent antibodies target a previously undefined site of vulnerability near the apex of the prefusion conformation of RSV F (preF), providing strong support for the development of RSV antibodies that target this region, as well as vaccine candidates that preserve the membrane-distal hemisphere of the preF protein. Additionally, this class of antibodies displayed convergent sequence features, thus providing a future means to rapidly detect these types of antibodies in human samples. Many of the antibodies that bound preF-specific surfaces from this donor were over 100 times more potent than palivizumab and several cross-neutralize human metapneumovirus (HMPV). Taken together, the results have implications for the design and evaluation of RSV vaccine and antibody-based therapeutic candidates, and offer new options for passive prophylaxis.

Large-Scale Isolation of RSV F-Specific Monoclonal Antibodies from Healthy Adult Human Donors In order to comprehensively profile the human antibody response to RSV F, Applicant isolated and characterized approximately 108 monoclonal antibodies from the memory B cells of a healthy adult donor ("donor 003"). Although this donor did not have a documented history of RSV infection, healthy adults are expected to have had multiple RSV infections throughout life (26).

Figure 1B:
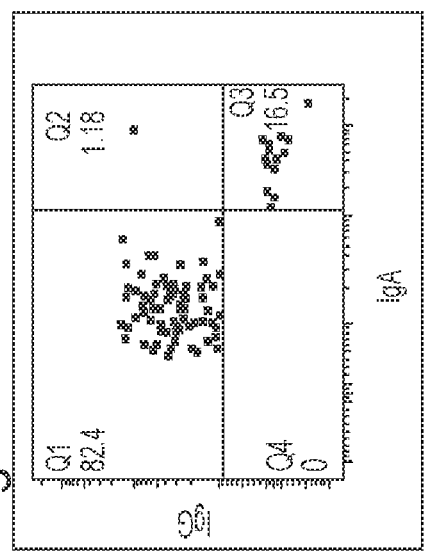
Figure 3B:
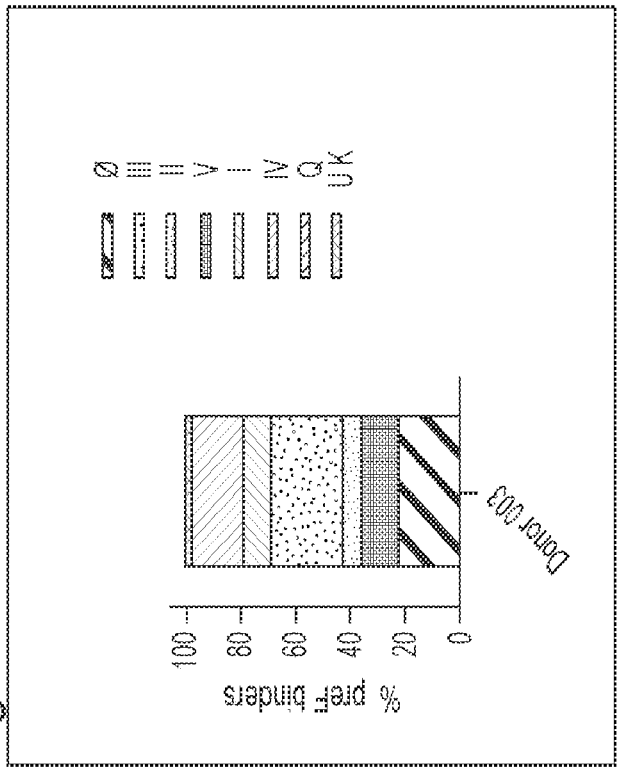
FIGS. 3A-3G illustrate mapping and specificities of anti-RSV antibodies for antigenic sites spanning the surface of PreF and PostF.
Figure 3A:
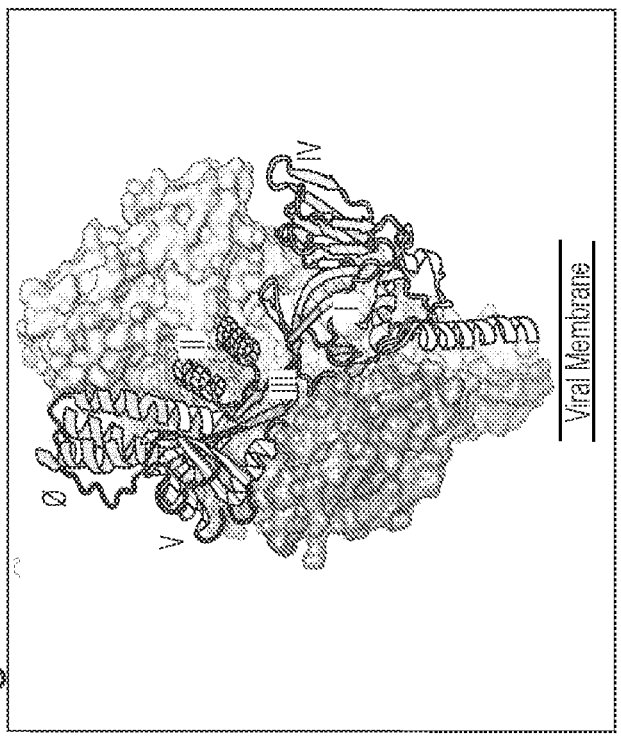
Figure 3C:
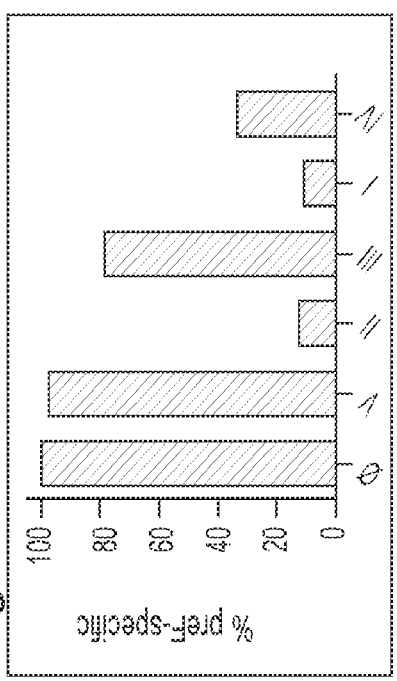
Figure 3D:
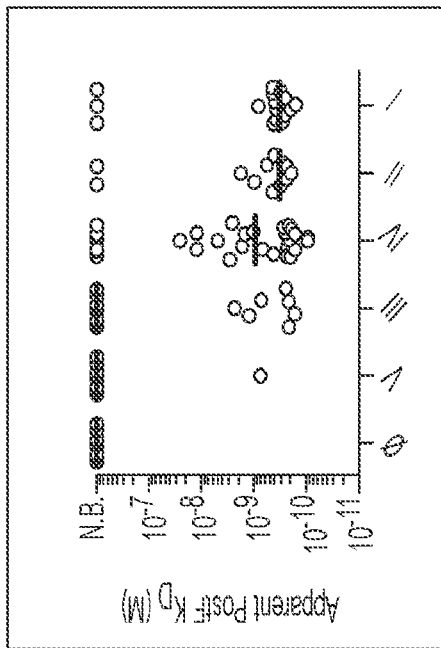
Figure 3E:
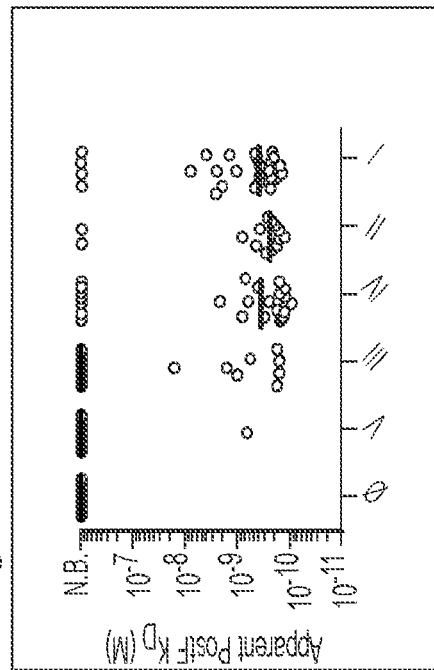
Figure 3F:
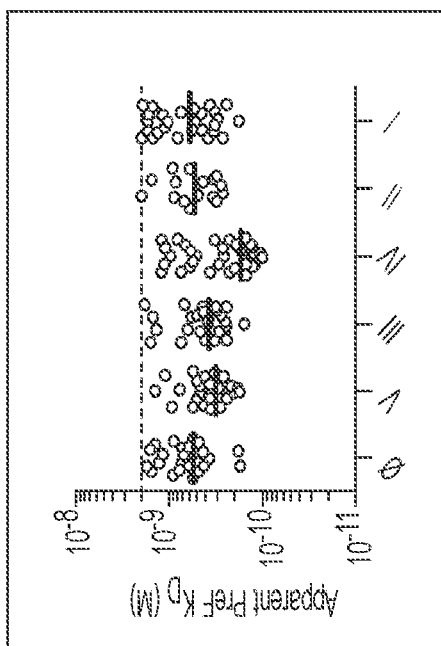
Figure 3G:
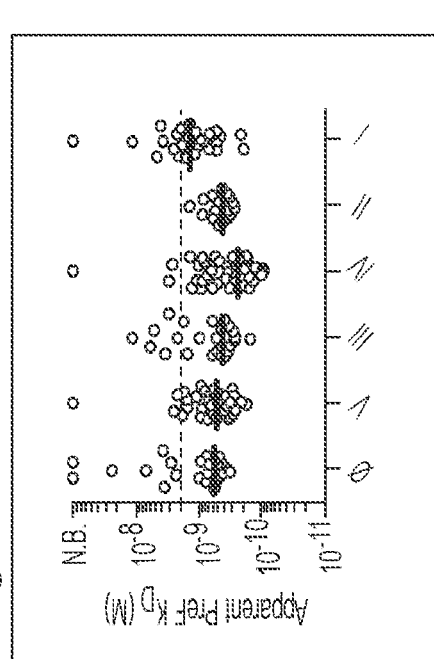
Figure 6B:
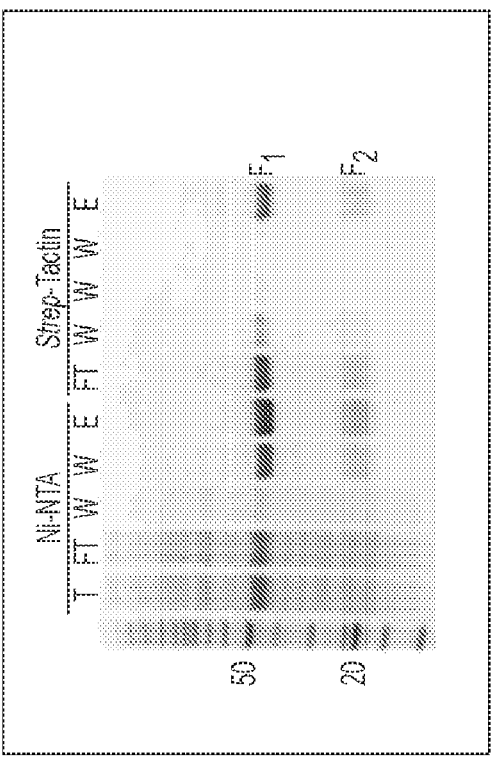
FIGS. 6A-6C illustrate the nature and purification of pre- and postF sorting probes.
Figure 6C:
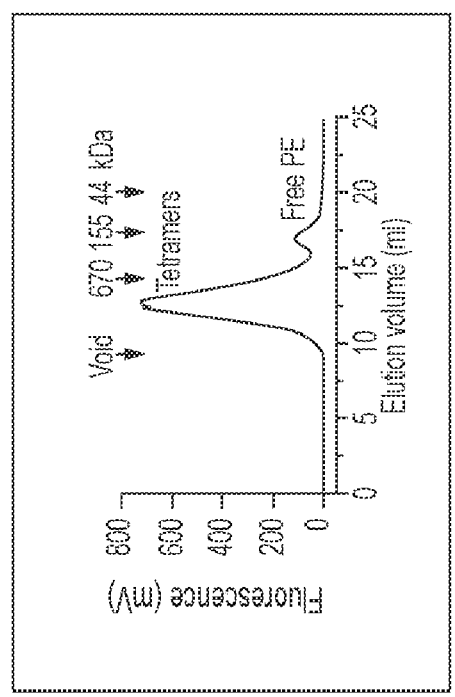
Figure 6A:
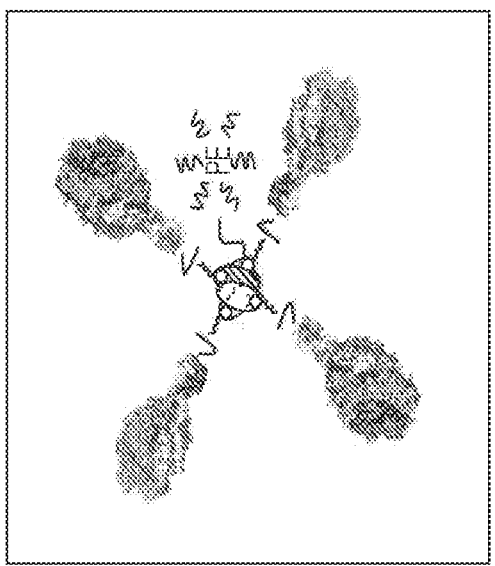

The magnitude of the memory B cell response in this donor to RSV F was assessed by staining peripheral B cells with a mixture of fluorescently labeled pre- and postfusion RSV F sorting probes (FIG. 6A through 6B) (11, 15). Both proteins were dual-labeled in order to eliminate background due to non-specific fluorochrome binding (27). Flow cytometric analysis revealed that 0.04-0.18% of class-switched (IgG$^+$ and IgA$^+$) peripheral B cells were specific for RSV F (FIG. 1A and Figure B), which is significantly lower than the percentage of RSV F-specific cells observed after experimental RSV infection and suggests that this donor was probably not recently exposed to RSV (28). Notably, index sorting showed that 17-38% of circulating RSV F-specific B cells express IgA, indicating that IgA memory B cells to RSV F are present in peripheral blood (FIG. 1B).

Approximately 200 RSV F-specific B cells were single-cell sorted from the donor sample, and antibody variable heavy (VH) and variable light (VL) chain genes were rescued by single-cell PCR (29). Over 100 cognate heavy and light chain pairs were subsequently cloned and expressed as full-length IgGs in an engineered strain of *Saccharomyces cerevisiae* for further characterization (30). Preliminary binding studies showed that approximately 80% of antibodies cloned from RSV F glycoprotein (F)-specific B cells bound to recombinant RSV F proteins.

Sequence Analysis of RSV F-Specific Antibody Repertoires

Sequence analysis of the isolated monoclonal antibodies revealed that the RSV-F specific repertoire was highly diverse, containing over 70 unique lineages (FIG. 1C and Table 2). This result is in stark contrast to the relatively restricted repertoires observed in HIV-infected patients (31), or in healthy donors after influenza vaccination (32). Compared to non-RSV-reactive antibodies (33), the RSV F-specific repertoires were skewed, generally, toward certain VH germline genes (VH1-18, VH1-2, VH1-69, VH2-70, VH4-304, and VH5-51) (FIG. 1D and Table 2) and longer heavy chain third complementarity-determining region (CDRH3) lengths (generally, approximately 14-18 amino acids in length; FIG. 1E and Table 2). Interestingly, a bias toward VH1-69 has also been observed in anti-HIV-1, anti-influenza, and anti-HCV repertoires (34-36), and recent studies have shown that there is a significant increase in the relative usage of VH1-18, VH1-2, and VH1-69 during acute dengue infection (37). Hence, it appears that these particular germline gene segments may have inherent properties that facilitate recognition of viral envelope proteins.

The average level of somatic hypermutation (SHM) ranged between 16 and 30 nucleotide substitutions per VH gene (excluding CDRH3) (FIG. 1F and Table 2), which is comparable to the average level of SHM observed in anti-influenza antibody repertoires (32, 38) and consistent with the recurrent nature of RSV infection (26). Interestingly, several antibodies contained 40 or greater VH gene nucleotide substitutions, suggesting that multiple rounds of RSV infection can result in antibodies with very high levels of somatic hypermutation (SHM).

A Large Proportion of Antibodies Bind Exclusively to preF

We next measured the apparent binding affinities of the IgGs to furin-cleaved RSV F ectodomains stabilized in the prefusion (DS-Cav1) or postfusion (F ΔFP) conformation using biolayer interferometry (11, 15). A relatively large proportion of the antibodies (36-67%) bound exclusively to preF (FIG. 2A and Figure B; Table 3). The vast majority of remaining antibodies bound to both pre- and postF, with only 5-7% of antibodies showing exclusive postF specificity (FIG. 2A and Figure B; Table 3). The low prevalence of postF-specific antibodies in these donor repertoires is consistent with the observation that less than 10% of anti-RSV F serum-binding activity specifically targets postF (8). Interestingly, however, the majority of cross-reactive antibodies bound with higher apparent affinity to postF (FIG. 2A; Table 3), suggesting that these antibodies were probably elicited by and/or affinity matured against postF in vivo. Hence, the significantly higher proportion of preF-versus postF-specific antibodies is likely due to the higher immunogenicity of the unique surfaces on preF compared to postF, rather than an increased abundance of preF in vivo. Finally, as expected based on the relatively high degree of sequence conservation between RSV subtypes, most of the antibodies showed binding reactivity to F proteins derived from both subtypes A and B (FIG. 2C; Table 3).

Since certain antiviral antibody specificities have been associated with poly- and autoreactivity (39-41), we also tested the RSV antibodies for polyreactivity using a previously described high-throughput assay that correlates with down-stream behaviors such as serum clearance (42, 43). One hundred and seventy-seven clinical antibodies, as well as several broadly neutralizing HIV antibodies, were also included for comparison. Interestingly, in contrast to many previously described HIV broadly neutralizing antibodies, the vast majority of RSV F-specific antibodies lacked significant polyreactivity in this assay (FIG. 2D).

RSV F-Specific Antibodies Target Six Major Antigenic Sites

To map the antigenic specificities of the RSV F-specific antibodies, Applicant first performed competitive binding experiments using a previously described yeast-based assay (44). Antibodies were initially tested for competition with D25, AM14 and MPE8—three previously described preF-specific antibodies (10, 17, 21)—and motavizumab, an affinity-matured variant of palivizumab that binds to both pre- and postF (10, 11, 45). Non-competing antibodies were then tested for competition with a site IV-directed mAb (101F) (46), a site I-directed antibody (Site I Ab), and two high affinity antibodies (High Affinity Ab I and High Affinity Ab 2, respectively) that did not strongly compete with each other or any of the control antibodies. Each antibody was assigned a bin based on the results of this competition assay (see, e.g., Table 4).

In order to confirm and increase the resolution of our epitope assignments, the binding of each antibody to a panel of preF variants was measured using a luminex-based assay. Each variant contained 2-4 mutations clustered together to form a patch on the surface of preF. A total of nine patches that uniformly covered the surface of preF were generated (FIG. 7A through FIG. 7C). Deglycosylated preF was also included to identify antibodies targeting glycan-dependent epitopes. Binding of each antibody to the 10 preF variants was compared to that of wild-type preF and used to assign a patch (see, e.g., Table 4). Previously characterized antibodies D25, AM14 and motavizumab were used to validate the assay (see, e.g., FIG. 7C and Table 4). The combined bin and patch data were then used to assign each antibody to a single antigenic site (FIG. 3A through FIG. 3G), which were defined based on previously determined structures, resistance mutations, and secondary structure elements of the F protein. Overall, these data show that the large majority of isolated antibodies target six dominant antigenic sites on prefusion RSV F (Ø, I, II, III, IV, and V). Interestingly, only a small proportion of the isolated antibodies had binding profiles similar to that of AM14, suggesting that antibodies targeting this quaternary epitope are not commonly elicited during natural infection. None of the antibodies were sensitive to deglycosylation of F, demonstrating that glycan-dependent antibodies are also rarely elicited by natural RSV infection.

Figure 8:
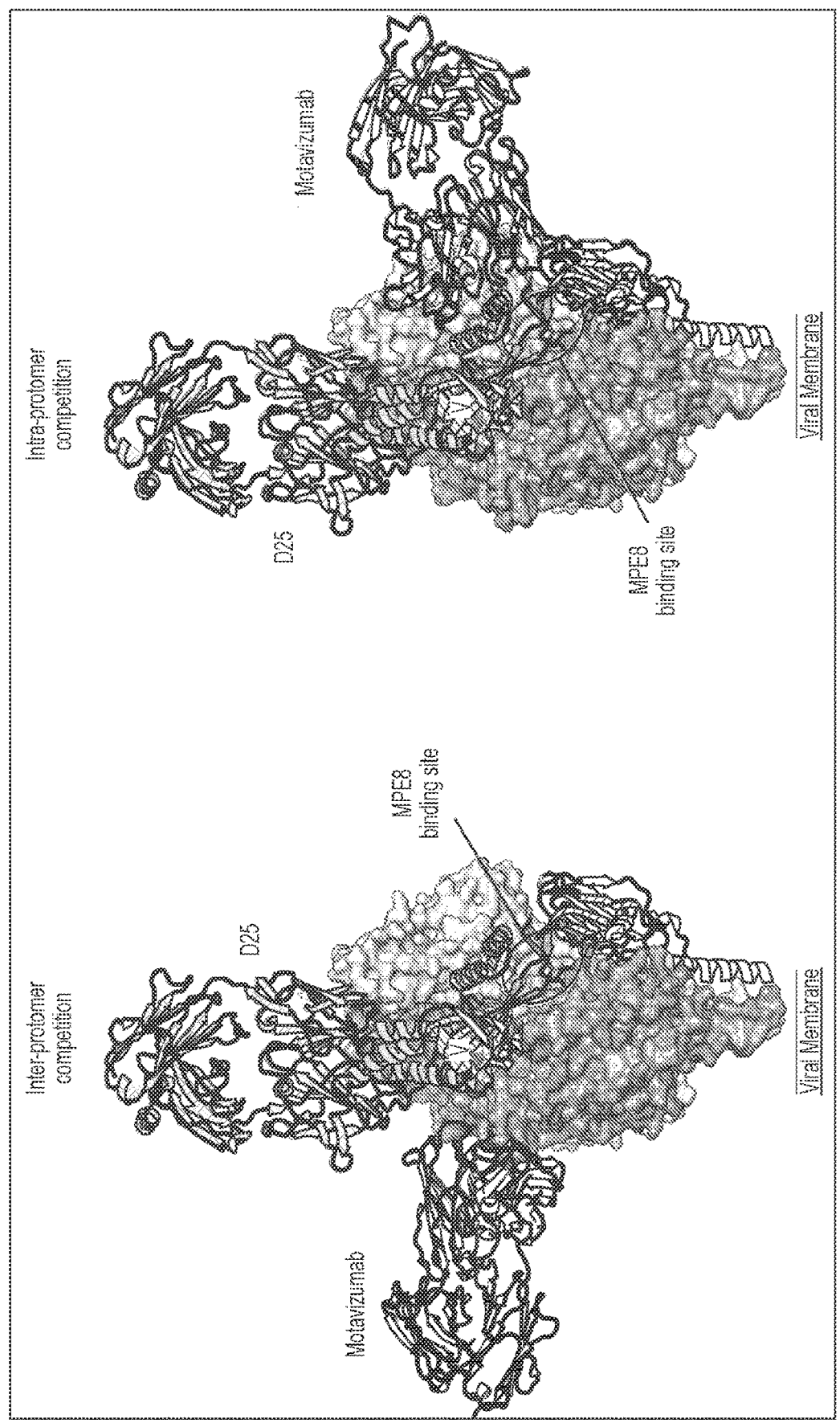
FIG. 8 illustrates the antigenic site V resides between the epitopes recognized by D25, MPE8 and motavizumab. Prefusion F is shown with one promoter as a cartoon colored according to antigenic site location and the other two protomers colored grey. D25 and motavizumab Fabs are shown in blue and pink, respectively. The MPE8 binding site is circled in black. Antigenic site V is located between the binding sites of D25 and MPE8 within one protomer, explaining the competition between site-V directed antibodies and these controls. Competition with motavizumab may occur across two adjacent protomers (left) or within one protomer (right), depending on the angle-of-approach of these site-V directed antibodies.

Analysis of the preF- and postF-binding activities of the antibodies targeting each antigenic site (see, e.g., FIG. 3C through FIG. 3G; Table 4) revealed that three sites are primarily found on preF (Ø, III, and V). Antibodies targeting site Ø and site III have been previously described (10, 17), and these sites are located on the top and side of the preF spike, respectively. Greater than 20% of the antibodies from this donor recognized site Ø and approximately 22% recognized site III. A relatively large proportion of antibodies from this donor (approximately 14%) recognized the third preF-specific site, which has not been previously described and therefore has been designated herein as region site V (See, e.g., FIG. 3C through FIG. 3G; Table 4). The majority of site V antibodies competed with D25, MPE8 and motavizumab, which was unexpected given the distance between the epitopes recognized by these three antibodies. The patch mutant analysis revealed that these antibodies interact with the α3 helix and β3/β4 hairpin of preF. This region is located between the epitopes recognized by D25, MPE8, and motavizumab, explaining the unusual competition profile observed for this class of antibodies (See, e.g., FIG. 8). In addition to the three primarily preF-specific sites, a large number of the antibodies that recognized antigenic site IV were preF-specific, likely due to contacts with β22, which dramatically rearranges during the transition from pre- to postF. In summary, the epitope mapping data show that the large majority of isolated antibodies target six dominant antigenic sites, approximately half of which are exclusively expressed on preF.

Highly Potent Neutralizing Antibodies Target preF-Specific Epitopes

Figure 4E:
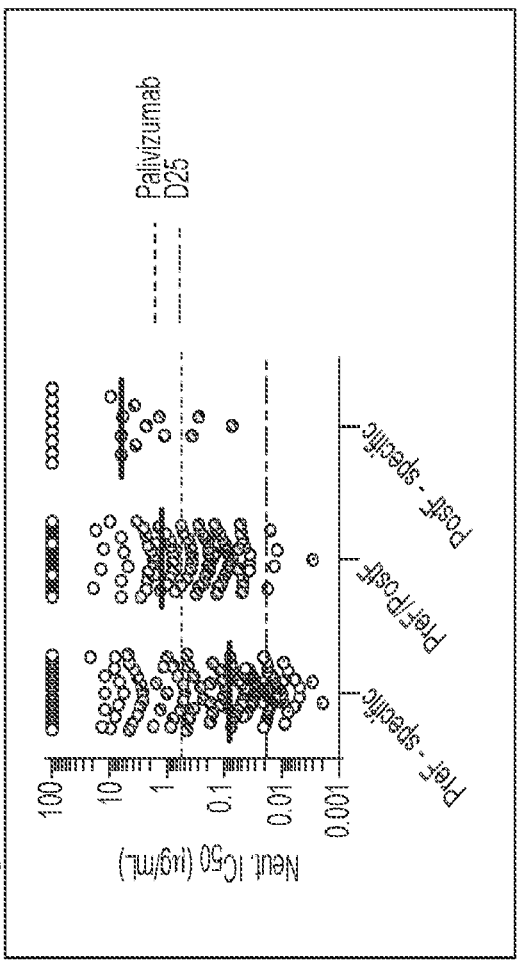
Figure 4G:
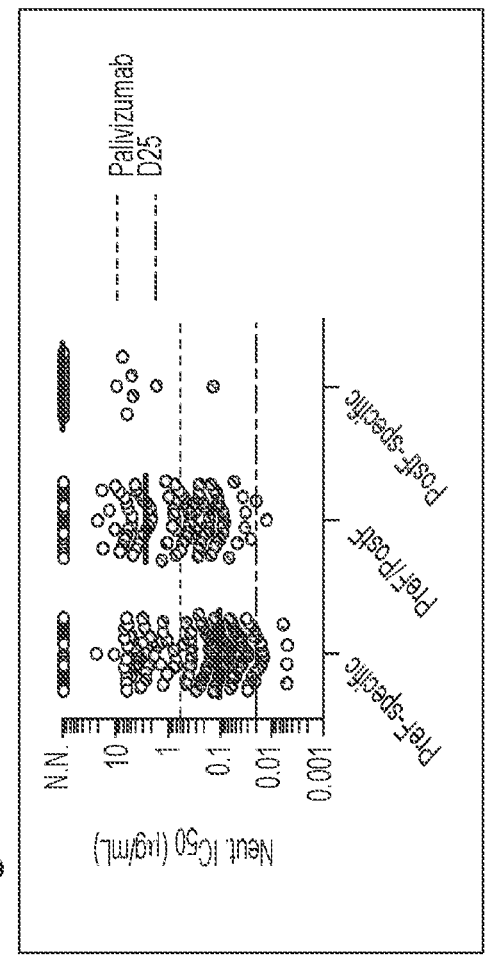
Figure 4D:
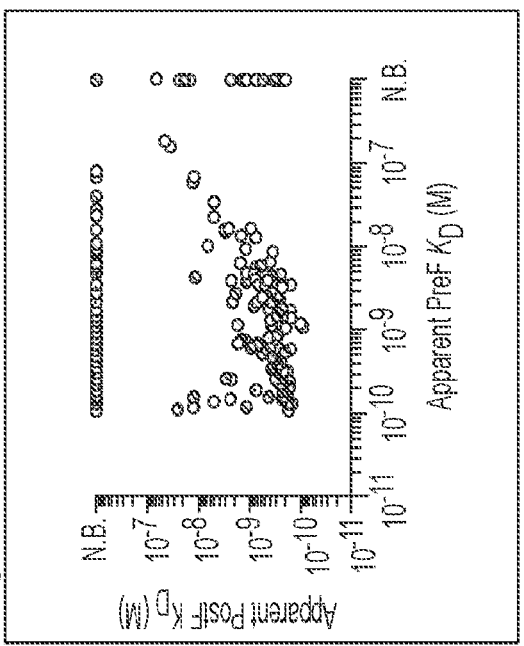
Figure 4F:
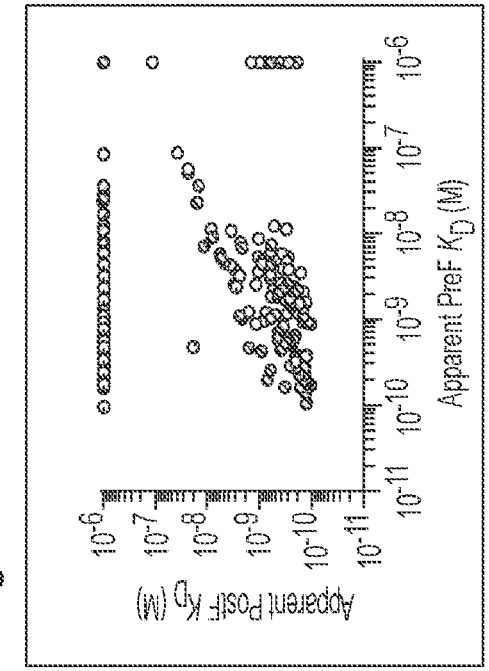

The antibodies were next tested for neutralizing activity against RSV subtypes A and B using a previously described high-throughput neutralization assay (15). Greater than 60% of the isolated antibodies showed neutralizing activity, and approximately 20% neutralized with high potency ($IC_{50} \leq 0.05$ μg/ml) (see, e.g., FIG. 4A and FIG. 4B; Table 3). Notably, several clonally unrelated antibodies were ≥5.0-fold more potent than D25 and ≥100-fold more potent than palivizumab (see, e.g., FIG. 4A; Table 3). Interestingly, there was no correlation between neutralization potency and level of SHM, suggesting that extensive SHM is not required for potent neutralization of RSV. Consistent with the binding cross-reactivity data, the majority of neutralizing antibodies showed activity against both subtype A and B (FIG. 4A through FIG. 4C; Table 3).

Figure 5B:
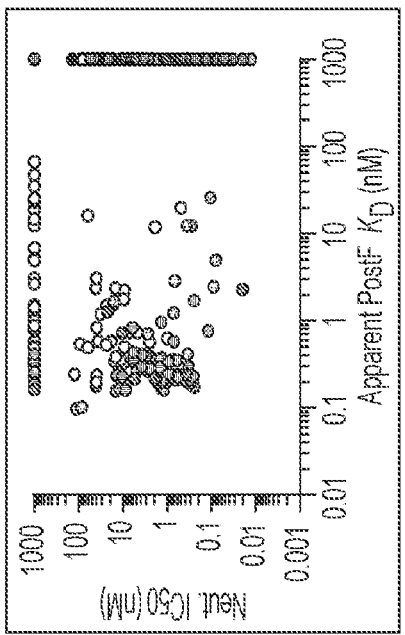
FIGS. 5A-5C illustrate that the most potent neutralizing antibodies bind with high affinity to preF and recognize antigenic sites Ø and V.
Figure 5A:
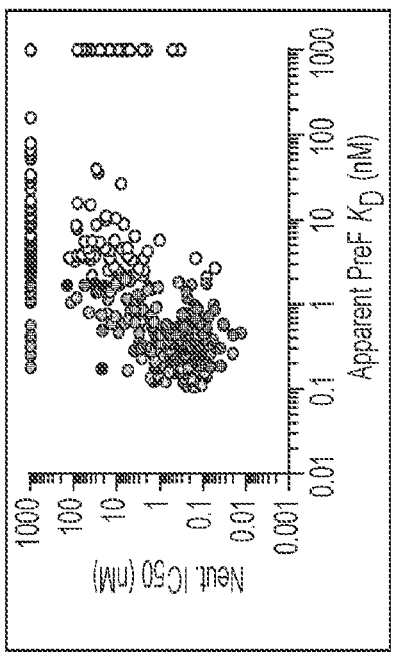
Figure 9:
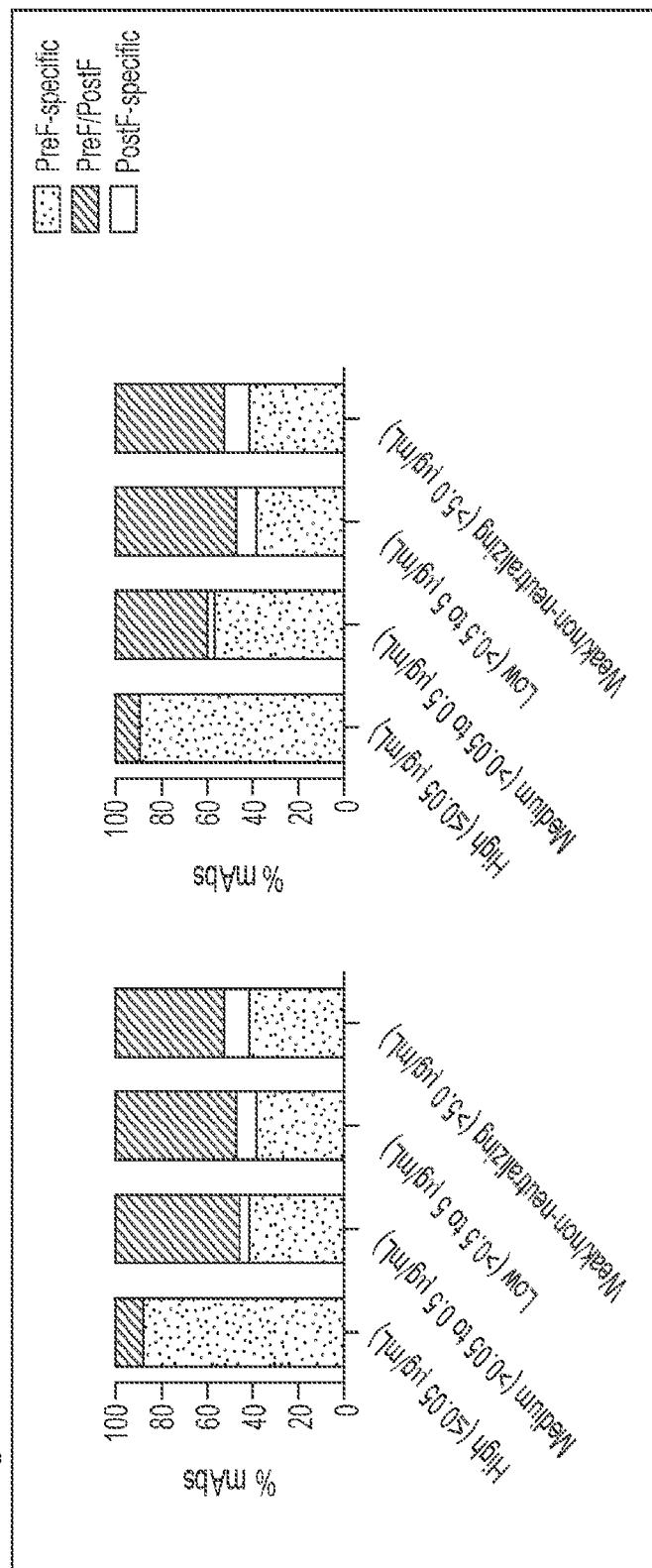
FIG. 9 illustrates percentage of anti-RSV antibodies demonstrating the indicated neutralizing activities of preF-specific, postF-specific, and cross-reactive antibodies. Antibodies were stratified according to neutralization potency and the percentage of antibodies in each group that were preF-specific (pink), postF-specific (white) or cross-reactive (orange) were plotted for subtype A (left panel) and subtype B (right panel).

The relationship between preF- and postF-binding affinity and neutralization potency was next investigated, which clearly demonstrated that the majority of highly potent antibodies bound preferentially or exclusively to preF (see, e.g., FIG. 4D through FIG. 4G; Table 3). Quantifying this difference revealed that more than 80% of highly potent antibodies (IC$_{50}$<0.05 µg/ml) were specific for preF (See, e.g., FIG. 9; Table 3) and that the median IC$_{50}$ for preF-specific antibodies was more than 8-fold lower than for pre- and postF cross-reactive antibodies and 80-fold lower than antibodies that specifically recognized postF (see, e.g., FIG. 4E; Table 3). Importantly, there was a positive correlation between preF binding and neutralization (P<0.001, r=0.24), and the apparent preF K$_D$s generally corresponded well with the neutralization IC$_{50}$s (see, e.g., FIG. 5A; Table 3). In contrast, there was no correlation between neutralization potency and postF affinity (P=0.44, r=-0.07) (see, e.g., FIG. 5B; Table 3). This result is compatible with the occupancy model of antibody-mediated neutralization (47), and suggests that DS-Cav1 is a faithful antigenic mimic of the native preF trimer. Notably, very few antibodies neutralized with IC$_{50}$s lower than 100 pM, which is consistent with the previously proposed ceiling to affinity maturation (48, 49).

Figure 5C:
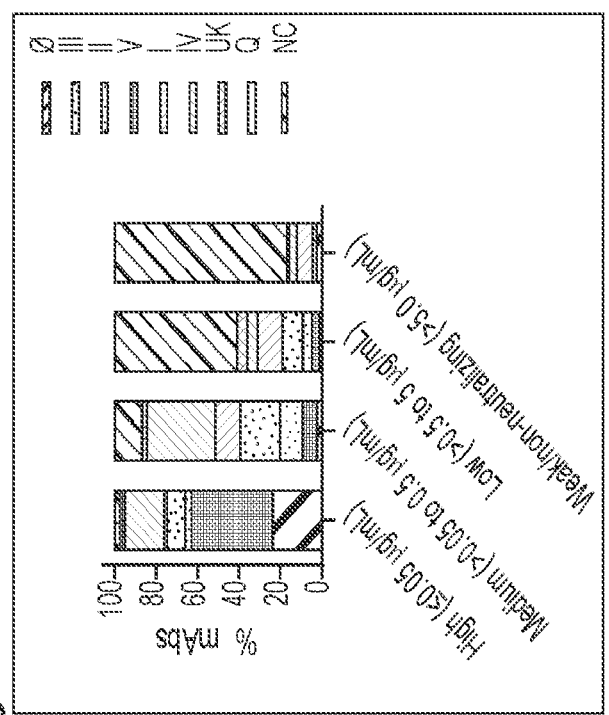
Figure 10B:
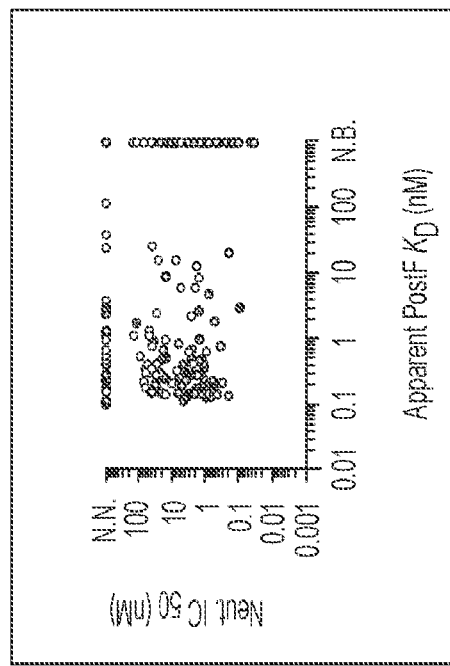
FIGS. 10A-10C illustrate the relationship between subtype B neutralization and antigenic site specificity for anti-RSV antibodies.
Figure 10A:
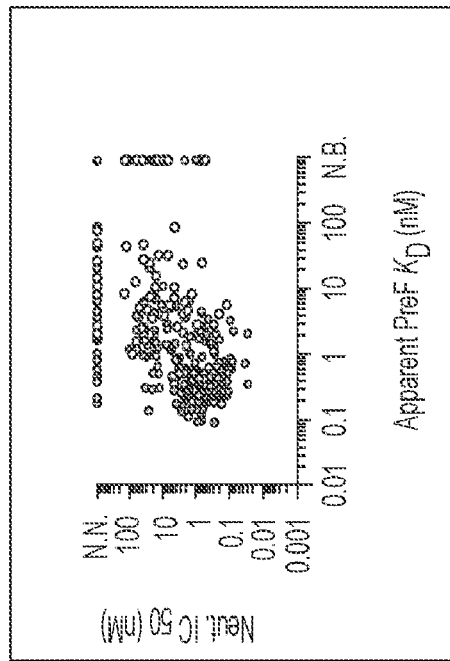
Figure 10C:
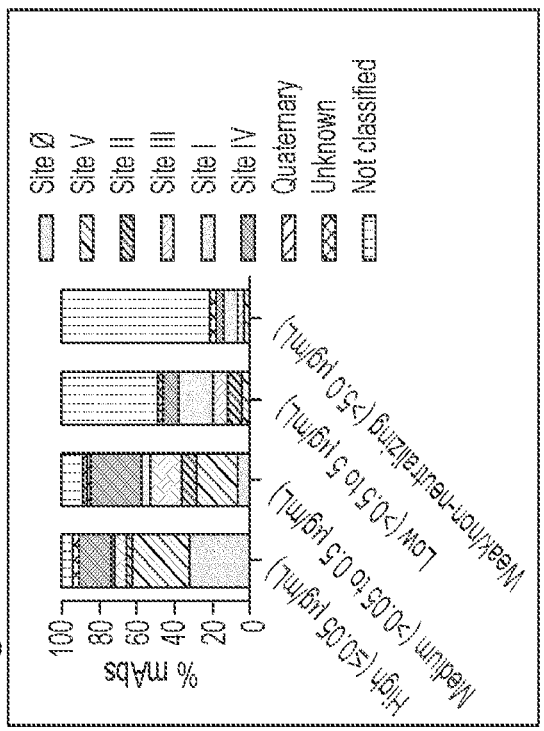

The relationship between neutralization potency and antigenic site was next analyzed. The results, provided in, e.g., FIG. 5C, Table 3, and Table 4, collectively, indicated that over 60% of the highly potent neutralizing antibodies targeted antigenic sites Ø and V, which are two of the three prefusion-F specific sites. In contrast, antibodies targeting sites III and IV showed a wide range of neutralization potencies, and antibodies targeting sites I and II were generally moderate to non-neutralizing. Similar results were obtained using binding affinities and neutralization potencies measured for subtype B (See, e.g., FIG. 10A through FIG. 10C; Table 3 and Table 4). Interestingly, a subset of site IV-directed antibodies neutralized with substantially lower potency than would be expected based on preF binding affinity (see, e.g., FIG. 5A; Table 3). This result may suggest that certain epitopes within site IV are less exposed in the context of the native envelope spike expressed on the crowded surface of the virion than on recombinant preF.

Several Antibodies Cross-Neutralize RSV and HMPV

Given that the RSV and human metapneumovirus (HMPV) F proteins share 33% amino acid identity, and certain RSV F-specific antibodies cross-neutralize HMPV (17, 50), the antibodies from this donor were tested for neutralizing activity against HMPV. Of the 108 antibodies tested, five neutralized HMPV and two showed highly potent activity against both HMPV and RSV (see, e.g., Table 5). Sequence analysis revealed that the five antibodies represent two different clonal families, which utilize different VH germline genes and have varying CDRH3 lengths and levels of somatic hypermutation (See, e.g., Table 2 and sequence listing). All of the cross-neutralizing antibodies bound exclusively to preF and competed with MPE8 (See, e.g., Table 5), in agreement with previous studies indicating that MPE8 cross-neutralizes four pneumoviruses, including RSV and HMPV (17). This result suggests, inter alia, that highly conserved epitopes are relatively immunogenic in the context of natural RSV and/or HMPV infection.

Affinity Maturation of RSV F-Specific Antibodies:

Some embodiments refer to affinity matured antibodies of any of the antibodies listed in Table 6 (each understood as a "parent" antibody for producing an affinity matured variant). Affinty matured antibodies may be produced by mutagenesis of any one or more of the CDRs of the parent antibody. According to a specific embodiment, the invention provides for affinity matured variants comprising one or more point mutations e.g., 0, 1, 2, or 3 point mutations in each of the CDR sequences, of any of the antibodies listed in Table 6, or of an antibody comprising the six CDR sequences of any of the antibodies listed in Table 6. Affinity matured variants can be produced by any affinity maturation method employing standard mutagenesis techniques, e.g., for optimizing the binding characteristics, such as increasing affinity of binding, or increasing Kon, or decreasing Koff, and can be characterized by a K$_D$ difference of at least 2 fold, 5 fold, 1 log, or 2 logs, or 3 logs, as compared to the parent antibody. Such affinity matured antibodies still have the same binding specificity as the parent antibody and e.g., an optimized affinity of binding the target epitope.

Selected anti RSV antibodies were identified for affinity maturation. Oligos were ordered which comprised CDRH1, CDRH2, CDRH3, CDRL1, CDRL2, and CDRL3 sequences that were variegated via NNK diversity. The NNK oligos were incorporated into the parent HC or LC via DNA shuffling, as described previously (Stemmer W P et al., DNA shuffling by random fragmentation and reassembly: In vitro recombination for molecular evolution. Proc Natl Acad Sci USA. 1994 Oct. 25; 91(22):10747-51). The library was then created by transforming the VH and VL PCR products into yeast already containing either the light chain or heavy chain plasmid of the parent. The diversified libraries were then selected using flow cytometry. For each FACS round, the libraries were affinity pressured using decreasing amounts of antigen and clones with improved binding affinities were sorted and propagated. Once improved binding populations were observed by flow cytometry (typically two rounds of selection), single yeast clones were be picked for sequencing and characterization (Table 6).

A specific embodiment refers to affinity matured variants of the antibodies 128, 133 and 227 in Table 6. Notably, the antibodies numbered 232 and 233 are affinity matured variant of the antibody numbered 128 in Table 6, the antibodies numbered 234-236 are affinity matured variant of the antibody numbered 133 in Table 6 and the antibodies numbered 237-244 are affinity matured variant of the antibody numbered 227 in Table 6

Antibody Production and Purification of Affinity Matured Antibodies

Yeast clones were grown to saturation and then induced for 48 h at 30° C. with shaking. After induction, yeast cells were pelleted and the supernatants were harvested for purification. IgGs were purified using a Protein A column and eluted with acetic acid, pH 2.0. Fab fragments were generated by papain digestion and purified over KappaSelect (GE Healthcare LifeSciences).

RSV In Vitro Neutralization in ELISA based Microneutralization Assays

Figure 11:
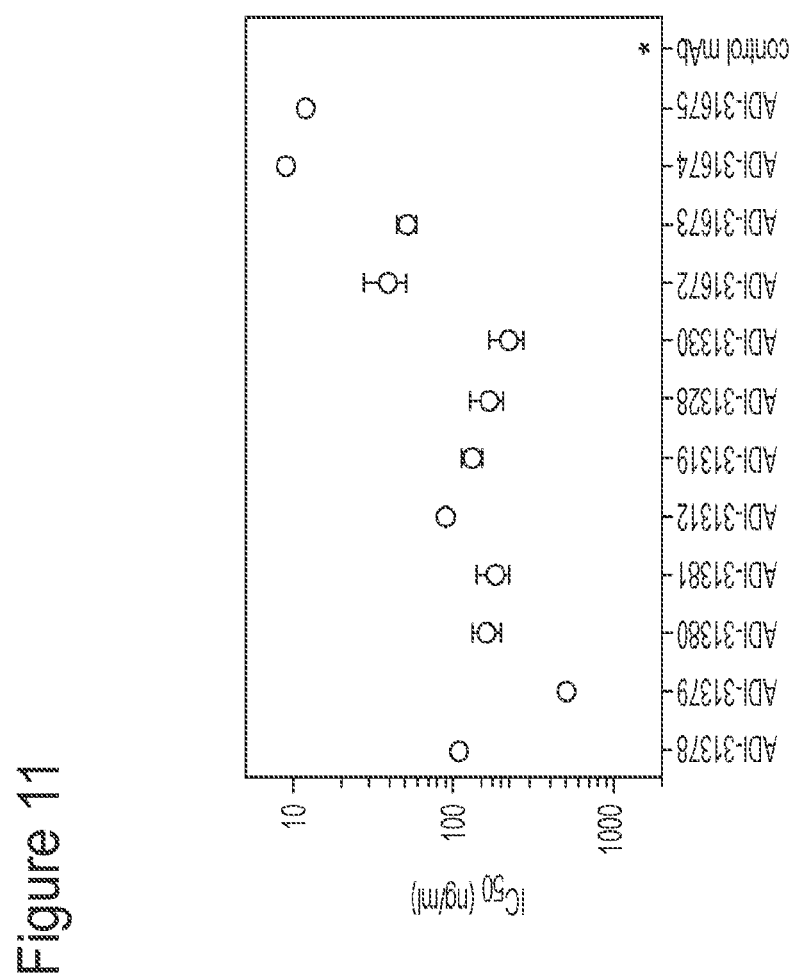
FIG. 11 illustrates in vitro neutralization of RSV A2. Inhibition of RSV-replication was measured in an ELISA based neutralization Assay using Hep-2 cells. Cells, mAbs and viruses were co-incubated for 4 days at 37° C., followed by quantification of viral proteins in infected cells using a polyclonal anti-RSV antibody. % inhibition was calculated relative to control cells infected with virus in absence of neutralizing antibody. Data are expressed as half-maximal inhibitory concentration that resulted in 50% reduction in virus replication (IC50) and represent the mean +/−SEM of two independent experiments. An isotype matched control mAb (*) was included in every experiment and did not exhibit virus neutralization.

In vitro RSV neutralization was tested in ELISA based Microneutralization Assays using RSV-A strain A2 (ATCC, VR1540P). Virus (at a final multiplicity of infection of approximately 0.25) was added to 96-well plates containing serially diluted mAbs in serum-free MEM and pre-incubated for 30 min at 4° C. Freshly trypsinized Hep-2 cells (1.5× 10E$^4$ cells/well) were then added to each well in MEM supplemented with 5% FCS. Following incubation for 4 days at 37° C. and 5% CO$_2$, medium was aspirated and cells were washed twice with 200 µl PBS/well, air-dried and fixed with 100 µl Acetone (80%). RSV replication was measured by quantification of expressed viral proteins by ELISA. For this purpose, fixed cells were washed 2×times with PBS-0.1% Tween-20, blocked with 1% skimmed milk in PBS for 1 hour at RT and then stained with a polyclonal goat-anti RSV antibody preparation (BioRad, #7950-0004) for 1 hour at RT in blocking buffer. A donkey anti-goat IgG HRP conjugate was used as detection reagent and 1 step-Ultra TMB (Thermo Fisher Scientific, #34209) as substrate. % inhibition of virus replication was calculated relative to control cells infected with virus in absence of neutralizing antibodies. An isotype matched control mAb was included in all experiments. mAb potency is expressed as half-maximal inhibitory concentration that resulted in 50% reduction in virus replication ($IC_{50}$). Results are provided in FIG. 11 and demonstrate that all mAbs were able to neutralize RSV-A2 in this setting, with a broad range of $IC_{50}$ values ranging from 8.5 ng/ml (ADI-31674) to 495.5 ng/ml (ADI-31379).

Discussion

An in-depth understanding of the human antibody response to RSV infection will aid the development and evaluation of RSV vaccine and therapeutic and/or prophylactic antibody candidates for the treatment and/or prevention of RSV infection. Although previous studies have coarsely mapped the epitopes targeted by RSV-specific neutralizing antibodies in human sera (4, 8), the specificities and functional properties of antibodies induced by natural RSV infection have remained largely undefined. As disclosed herein, preF- and postF-stabilized proteins (11, 15), a high-throughput antibody isolation platform, and a structure-guided collection of prefusion F mutants, were used to clonally dissect the human memory B cell response to RSV F in a naturally infected adult donor, and highly potent and selective RSV-neutralizing—as well as highly potent anti-RSV/anti-HMPV cross-selective and cross-neutralizing—were isolated and characterized.

In the repertoire analyzed, the ratio of preF-specific antibodies to those that recognize both pre- and postF was slightly greater than 1:1 (See, e.g., FIG. 2B). These values are somewhat lower than those reported for human sera, which showed approximately 70% of anti-F serum binding is specific for preF (8). This discrepancy may be the result of differences between the levels of individual antibodies in serum, differences in the B cell phenotypes achieved for a particular specificity, or variation between donors. Despite these minor differences, the results of both studies suggest that preF-specific epitopes and epitopes shared by pre- and postF are immunogenic during natural RSV infection, whereas the unique surfaces on postF are significantly less immunogenic.

The repertoire analysis disclosed herein revealed that the large majority of RSV F-specific antibodies target six dominant antigenic sites on prefusion RSV F: Ø, I, II, III, IV, and V. These sites were defined based on previously determined structures, epitope binning/competition assays, resistance mutations, and secondary structure elements of the preF protein. It is important to note that the nomenclature for describing RSV F antigenic sites has evolved over time (6, 51-57), and previous mapping efforts were based on the postfusion conformation of F and did not include surfaces present exclusively on preF. The crystal structure of preF has provided critical information about F structure and function as well as new reagents to map antibody binding sites on the unique surfaces of preF and surfaces shared with postF. To a first approximation, each antibody can be assigned primarily to one of these sites. However, it is likely that antibody epitopes cover the entire surface of F and that there are antibodies that bind two or more adjacent antigenic sites within a protomer and quaternary antibodies that bind across protomers.

Importantly, the results disclosed herein show that the most potently neutralizing antibodies target antigenic sites Ø and V, both of which are located near the apex of the preF trimer. These findings are consistent with results obtained from human sera mapping, which determined that the majority of neutralizing activity can be removed by pre-incubation with preF (4, 8) and that preF-specific sites other than site Ø make up a considerable fraction of preF-specific neutralizing antibodies (8). Although antigenic site Ø has been shown to be a target of potently neutralizing antibodies (8, 10), the interaction of antibodies with site V is less well understood. Interestingly, it was found that the majority of site V-directed antibodies share several convergent sequence features, suggesting that it may be possible to rapidly detect these types of antibodies in human samples using high-throughput sequencing technology (58). Applicant anticipates this finding to be particularly advantageous in profiling antibody responses to RSV vaccine candidates that aim to preserve the apex of the preF trimer.

The extensive panel of antibodies described here provides new opportunities for passive prophylaxis, as well as for treatment of RSV infection. A large number of these antibodies neutralize RSV more potently than D25, which serves as the basis for MEDI8897—a monoclonal antibody that is currently in clinical trials for the prevention of RSV in young, at risk children (59). Additionally, a sub-set of these antibodies were demonstrated to cross-neutralize HMPV.

The development of an effective RSV vaccine has presented a number of unique challenges, and selection of the optimal vaccination strategy will be of the utmost importance. The in-depth analysis of the human antibody response to natural RSV infection presented here provides insights for the development of such a vaccine. Importantly, the results suggest that immunization of pre-immune donors with preF immunogens would be expected to boost neutralizing responses, whereas the use of postF immunogens would likely expand B cell clones with moderate or weak neutralizing activity. Similarly, immunization of RSV naive infants with preF immunogens would be expected to activate naive B cells targeting epitopes associated with substantially more potent neutralizing activity compared to postF immunogens. In addition, the ideal RSV vaccine should preserve antigenic sites Ø and V, since these sites are targeted by the most highly potent antibodies elicited in response to natural RSV infection.

Accordingly, disclosed herein are highly selective and potent anti-RSV antibodies, as well as highly potent cross-neutralizing anti-RSV and anti-HMPV antibodies, as well as vaccine candidates, for the treatment and or prophylaxis of RSV and/or HMPV infection. Additionally, the reagents disclosed here provide a useful set of tools for the evaluation of clinical trials, which will be critical for selecting the optimal RSV vaccination or antibody-based therapeutic strategy from the many currently under investigation (60).

TABLE 1

Antigenic sites targeted by prototypic RSV antibodies

| Antigenic site | Prototypic antibodies |
|---|---|
| Ø | D25, 5C4, AM22 (10, 16) |
| I | 131-2a, 2F |
| II | 1129, palivizumab, motavisumab (6) |
| III | MPE8 (17) |
| IV | 101F (57), mAb 19 (19) |

TABLE 2

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-15005 | 124 | VH2-70 | VK1-39 | ARTHIYDSSGYYLYYFDY | QQSYSSPWT | 68 | 7 | 10 |
| ADI-15006 | 125 | VH4-304 | VK1-39 | ARGKYYDRGGYYLFYLDY | QQSYSTPIFT | 51 | 17 | 10 |
| ADI-15555 | 126 | VH3-15 | VL1-40 | TTDRGITARPIFDS | QSYDGGLSGYV | 82 | 15 | 9 |
| ADI-15556 | 127 | VH1-69 | VL1-40 | ARDLDYDILTGYSVNYYYYGMDV | QSCDSSLSGWV | 28 | 12 | 1 |
| ADI-15557 | 128 | VH1-69 | VL3-21 | ASLRYFDWQPGGSYWFDP | QVWDTIDDHKDGL | 73 | 6 | 6 |
| ADI-15558 | 129 | VH1-18 | VL3-1 | ARDYIVAIVAALPHGMDV | QAWDSSIRV | 43 | 12 | 11 |
| ADI-15559 | 130 | VH1-69 | VK3-20 | ATDSYYVWTGSYPPPFDL | QQYGSWPLT | 76 | 30 | 21 |
| ADI-15560 | 131 | VH3-30 | VL3-21 | ARDPLGIGVKGYVDF | QVWDSISDHLV | 32 | 17 | 9 |
| ADI-15561 | 132 | VH1-69 | VK1-39 | ARSPPFWSDYSRGWFDP | QQSYTTPWT | 66 | 8 | 8 |
| ADI-15562 | 133 | VH5-51 | VK1-33 | ATQGLEGAFDY | QHYDSFPIFT | 77 | 21 | 10 |
| ADI-15563 | 134 | VH3-9 | VK3-15 | VKDGYTSSWHSDYHYGLDV | QQYNNWPLT | 85 | 7 | 8 |
| ADI-15564 | 135 | VH1-69 | VK3-20 | ARDNYYVWTGRYPEFDF | QQYGSTPIT | 29 | 16 | 12 |
| ADI-15565 | 136 | VH1-8 | VL1-40 | VYNFWSDSSVS | QSYDSSLRGYV | 89 | 18 | 9 |
| ADI-15566 | 137 | VH1-18 | VK2-30 | ARESGVAAAATLLY | MQGIYWPRT | 48 | 11 | 2 |
| ADI-15568 | 138 | VH1-46 | VK1-39 | GREDSYCSGDSCFNSGSGRWVDS | QQTYSTPHT | 78 | 24 | 8 |
| ADI-15569 | 139 | VH1-18 | VK2-30 | ARDPGVTAAVLLDY | LQGTPPYT | 30 | 8 | 4 |
| ADI-15570 | 140 | VH3-30 | VK1D-8 | ARGRTSHINTPETK | QQYYSLPWT | 54 | 15 | 14 |
| ADI-15571 | 141 | VH1-2 | VL1-51 | ARDVLWLNGF | GTWDSSLSTGPYVV | 41 | 10 | 4 |
| ADI-15572 | 142 | VH1-46 | VK1-9 | ARARIQLWAPNYYGMDV | QQLNRYPLT | 20 | 14 | 7 |
| ADI-15573 | 143 | VH1-18 | VL3-21 | ARADGGSGSYYSA | QLWDSSSDSHV | 14 | 16 | 5 |
| ADI-15574 | 144 | VH3-21 | VL1-40 | ARAPLLPAMMDL | QSYDRSLNGYV | 17 | 18 | 3 |
| ADI-15575 | 145 | VH1-8 | VL1-40 | VYDFWSDDSVK | QSFDSSLRGYV | 89 | 50 | 10 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-15576 | 146 | VH5-51 | VL1-44 | ARHSSPYSSGWYGDTYFFDS | AAWDDSLRGYV | 58 | 13 | 6 |
| ADI-15577 | 147 | VH1-69 | VL2-14 | ARGVFRVGCSDTSCLKNYYGTDV | SSYSSSSTLVV | 56 | 4 | 13 |
| ADI-15578 | 148 | VH3-48 | VK3-11 | ARDAGPVWSGYYDYGMDV | QQRYNWPPLT | 23 | 9 | 4 |
| ADI-15579 | 149 | VH3-9 | VK1-39 | AKTDGAVAVDGPFDY | QQSYIAPPT | 10 | 5 | 6 |
| ADI-15581 | 150 | VH1-69 | VK3-11 | AGAPYPMDV | QQRTNWQGLS | 1 | 9 | 3 |
| ADI-15582 | 151 | VH1-18 | VK1-39 | ARRYDILTGGGWFDS | QQSYSTPLS | 65 | 8 | 4 |
| ADI-15583 | 152 | VH5-51 | VK3-20 | ARQDNSGWADFFPFDY | QQYDSSPWT | 64 | 8 | 5 |
| ADI-15586 | 153 | VH3-30 | VL1-47 | ARDPLFLYNYEPFDY | SVWDDSLNGRL | 31 | 17 | 6 |
| ADI-15587 | 154 | VH3-20 | VK1-9 | ARVGGITKWWYYGMDL | QHLNSYPLT | 69 | 8 | 6 |
| ADI-15588 | 155 | VH4-61 | VK3-20 | ARDVGSTPYNYYGMDV | QQFGRSPELT | 40 | 20 | 13 |
| ADI-15589 | 156 | VH4-34 | VL2-14 | ARAPWYTHAMDV | SSYTNSNTLGV | 19 | 9 | 6 |
| ADI-15590 | 157 | VH3-43 | VK1-33 | AKTKYRGTYYYFDS | QQYDNLPPVT | 11 | 13 | 1 |
| ADI-15591 | 158 | VH3-21 | VL1-40 | AREDYDSRVYYLKWFDP | QSYDSSRSGYV | 45 | 11 | 2 |
| ADI-15592 | 159 | VH3-15 | VL1-40 | TTDRGITARPIFDS | QSYDGGLSGYV | 82 | 16 | 9 |
| ADI-15593 | 160 | VH3-21 | VK2-28 | ARYFGDYSGLGNYYYYGMDV | MQALQTPR | 72 | 15 | 4 |
| ADI-15594 | 161 | VH3-48 | VK1-39 | ARDFPPINLAATTRNYYYVMDV | QQSYSTSYT | 26 | 6 | 4 |
| ADI-15595 | 162 | VH2-5 | VL3-21 | TYARYSSALFGGYYFHS | QVWESSGDHPRI | 83 | 13 | 6 |
| ADI-15596 | 163 | VH3-15 | VL1-40 | TTDRGITARPIFDS | QSYDGGLSGYV | 82 | 18 | 10 |
| ADI-15597 | 164 | VH3-21 | VL1-40 | ARADYDRSVYHLNWFDP | QSYDSSLSGTWV | 15 | 5 | 3 |
| ADI-15599 | 165 | VH3-49 | VL6-57 | TMAVVVPGATDAFDI | HSYDSSNPWV | 81 | 3 | 5 |
| ADI-15600 | 166 | VH3-53 | VK3-20 | ARELVPNFYESHGYFSV | QQYGFSQT | 46 | 10 | 5 |
| ADI-15601 | 167 | VH3-23 | VK3-15 | AKDADFWSGEAYNGGYNFDS | QQYNQWPPIT | 2 | 25 | 6 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-15602 | 168 | VH3-30 | VK3-20 | AKDLAWIFGLGASYMDV | QQYGSSPFGLT | 6 | 10 | 2 |
| ADI-15603 | 169 | VH3-23 | VK3-15 | ARSWDDYGDLDWYFAL | QQYSDWPPLT | 67 | 24 | 6 |
| ADI-15604 | 170 | VH3-11 | VL1-40 | ARFPLYCSRSSCSHYVDY | QSYDRSLSVV | 50 | 8 | 4 |
| ADI-15605 | 171 | VH5-51 | VL6-57 | ARFEYGDFGF | QSYDSSNHRV | 49 | 11 | 2 |
| ADI-15606 | 172 | VH3-23 | VK3-15 | AKSWDDYGDLDWYFAL | QQYSDWPPLT | 9 | 16 | 5 |
| ADI-15607 | 173 | VH3-23 | VL2-11 | AKELREYYYDSSGFDY | CSYAGTYTYV | 8 | 5 | 2 |
| ADI-15609 | 174 | VH3-30 | VK1-39 | ASQGYHYVNMADVGVPSFDH | QQSYMTPPT | 74 | 17 | 12 |
| ADI-15610 | 175 | VH1-69 | VK1-39 | AKTVSQYPNTYNYGMDV | LQTYSTPLT | 12 | 8 | 6 |
| ADI-15611 | 176 | VH1-69 | VK3-11 | ARVPPPRGHCESTSCLWGTYFAF | QLRDYWPPTWT | 71 | 12 | 4 |
| ADI-15612 | 177 | VH3-48 | VK1-39 | ARDQYIWNYVEPLDY | LQDHTCPWT | 34 | 12 | 12 |
| ADI-15613 | 178 | VH1-69 | VK3-11 | ARDRGNNGRYYAMDV | QQRNNWPPT | 36 | 17 | 3 |
| ADI-15614 | 179 | VH3-21 | VL1-40 | ARAPLLPAMMDL | QSYDRSLNGYV | 17 | 16 | 3 |
| ADI-15615 | 180 | VH3-21 | VL1-40 | ARADYDRSVYHLNWLDP | QSYDSSLSGTWV | 15 | 5 | 3 |
| ADI-15616 | 181 | VH3-11 | VK3-20 | ARDRNWGYAYGSDY | QLYGNSRT | 37 | 5 | 4 |
| ADI-15617 | 182 | VH3-23 | VK1-33 | AKDDPTLFWSGSGYYGMDV | QQYDNLPLT | 4 | 45 | 11 |
| ADI-15618 | 183 | VH3-53 | VK3-11 | ARMETVTTDAGSGWDWYFEV | QQHRDWRPVT | 63 | 44 | 12 |
| ADI-15619 | 184 | VH1-8 | VL1-40 | VYNFWSDSSVS | QSFDSSLRGYV | 89 | 17 | 11 |
| ADI-15620 | 185 | VH1-8 | VL3-1 | AREARDLRVGATNFDY | QAWDSSIDVV | 44 | 6 | 7 |
| ADI-15621 | 186 | VH1-69 | VK3-20 | ARDNYYVWTGHYPEFDF | QQYGSTPIT | 29 | 21 | 17 |
| ADI-15622 | 187 | VH3-23 | VK1-12 | ARIVIVGVLRFQEWLSSDGMDV | QQANSFPFT | 60 | 16 | 7 |
| ADI-15623 | 188 | VH3-21 | VL1-40 | ARAPLLPAMMDL | QSYDRSLNGYV | 17 | 17 | 3 |
| ADI-15624 | 189 | VH3-11 | VL1-40 | ARIRPDDSSGYPDY | QSYDSSLSGFV | 59 | 8 | 2 |

TABLE 2-continued

Germline usage and sequence information of anti-RSV antibodies

| Antibody Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-15625 | 190 | VH1-46 | VL3-1 | ARDRAGCSGGSCYYYGMDV | QAWDSRTVV | 35 | 6 | 2 |
| ADI-15626 | 191 | VH1-69 | VK1-5 | ARERYPSTDDYYRSGRYYGE | QQYNSIPVT | 47 | 11 | 9 |
| ADI-15627 | 192 | VH3-30 | VL3-21 | AKDRGSIWNVGDGMDV | QVWDASIGPLYV | 7 | 6 | 5 |
| ADI-15628 | 193 | VH3-30 | VL2-14 | ARDAVPHYDYVWGNFDY | SSYTSFTPVV | 24 | 15 | 4 |
| ADI-15629 | 194 | VH3-23 | VK3-15 | AKDADFWSGDSYNGGYNFDS | QQYNKWPPLT | 2 | 20 | 3 |
| ADI-15630 | 195 | VH3-11 | VK1-33 | AQGWYSDFWSGPIRI | QQNDNLVLT | 13 | 8 | 5 |
| ADI-15631 | 196 | VH3-9 | VK3-15 | AKDAHYFDNSGHYYYGLDV | QQYNNWPLT | 3 | 5 | 6 |
| ADI-15632 | 197 | VH3-49 | VK2-28 | SGASRGFWSGPTYYYFGMDV | MQPLQTT | 79 | 16 | 10 |
| ADI-15633 | 198 | VH5-51 | VL6-57 | ARLRLHPQSGMDV | QSYDNAIWV | 62 | 18 | 8 |
| ADI-15634 | 199 | VH1-69 | VK3-11 | ARDRSVTPRYYGMDV | QHRSNWPPLT | 38 | 1 | 0 |
| ADI-15635 | 200 | VH3-21 | VL1-40 | ARAPLLPAMMDL | QSYDRSLNGYV | 17 | 16 | 3 |
| ADI-15636 | 201 | VH1-69 | VK1-9 | ARLAGPRWPGYGMDV | QQLNSFPLT | 61 | 8 | 0 |
| ADI-15637 | 202 | VH1-24 | VK1-39 | SSVGPAGWFDP | HQSYIPPFT | 80 | 15 | 3 |
| ADI-15638 | 203 | VH3-21 | VL1-40 | VRDSGHQDYRGDY | QSYDRSLSGWV | 88 | 7 | 5 |
| ADI-15640 | 204 | VH2-70 | VK1-39 | ARASLYDSGGYYLFFFDY | QLSYSSLWT | 21 | 6 | 7 |
| ADI-15641 | 205 | VH3-30 | VL2-14 | AKDGYLAPDF | SSYTSSSGQA | 5 | 12 | 8 |
| ADI-15642 | 206 | VH3-53 | VK1-27 | ARDDYDFWSGNGPPEMAV | QKYNSVPLT | 25 | 3 | 1 |
| ADI-15643 | 207 | VH5-51 | VK3-20 | ARQDDSGWADFFPFDY | QQYDSSPWT | 64 | 8 | 6 |
| ADI-15644 | 208 | VH1-69 | VK1-5 | ARDSPKISATEYYFDY | QHYDSYSGT | 9 | 8 | 6 |
| ADI-15645 | 209 | VH3-23 | VK1-12 | ARGYHIDWFDF | QQAKSLPRT | 57 | 13 | 8 |
| ADI-15646 | 210 | VH3-53 | VK3-20 | ARAGVVGEDRSGWYGPDYFHGLDV | QQYGGSPYT | 16 | 16 | 9 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-15647 | 211 | VH1-69 | VK3-11 | ARVGLGRTWIYDTMGYLDY | QHRTNWPSLT | 70 | 15 | 4 |
| ADI-15648 | 212 | VH3-21 | VL1-40 | ARAPLLPAMMDL | QSYDRSLNGYV | 17 | 16 | 3 |
| ADI-15649 | 213 | VH3-21 | VL1-40 | VRDHCTGGSCYLNGMDV | QSYDSSLSGSV | 87 | 9 | 2 |
| ADI-15650 | 214 | VH3-53 | VK1-27 | ARDDYDFWSGNGPPEMAV | QKYDSVPLT | 25 | 2 | 4 |
| ADI-15651 | 215 | VH2-70 | VK1-39 | ARTNRYDKSGYYLYYLDY | QQSYSSFFT | 68 | 28 | 14 |
| ADI-15652 | 216 | VH3-30 | VL2-14 | ARDAVPHYDYVWGNFDY | SSYTSFTPVV | 24 | 16 | 3 |
| ADI-15653 | 217 | VH1-69 | VL3-21 | ARGSGGSNAYFDP | QVWDSRSDHPYV | 55 | 14 | 8 |
| ADI-15654 | 218 | VH1-69 | VL2-14 | VRDERNGGY | SSYTISSTLV | 86 | 51 | 8 |
| ADI-15655 | 219 | VH3-30 | VK2-28 | ARDYIHGDYGLDV | MQPLQTIT | 42 | 7 | 0 |
| ADI-15656 | 220 | VH1-2 | VL1-40 | ASRSWDHDAFDI | HCYDSRLSVV | 75 | 6 | 3 |
| ADI-15657 | 221 | VH1-69 | VK3-11 | ARVGVGRTWIYDTMGYLDF | QHRSDWPSLT | 70 | 12 | 3 |
| ADI-15658 | 222 | VH3-9 | VL1-47 | VKDGTPIAVAGYFEY | AVWDDSLSCYV | 84 | 10 | 8 |
| ADI-15659 | 223 | VH1-69 | VL3-21 | ARCPPFEGVRPPWFDP | QVWETSSDHPV | 22 | 10 | 15 |
| ADI-15660 | 224 | VH5-51 | VL6-57 | ARGPFPHYFDS | QSYDPTNQNV | 52 | 23 | 4 |
| ADI-15661 | 225 | VH3-30 | VL3-21 | ARAPVTGASYYLDY | QVWDSTSDHLV | 18 | 20 | 6 |
| ADI-15662 | 226 | VH4-61 | VK3-11 | ARDIGEDKYGTYYGMDV | QQRTNWPPVT | 27 | 2 | 2 |
| ADI-15663 | 227 | VH3-21 | VL1-40 | ARDQPGTIFGVVQDY | QSYDSRLSVV | 33 | 12 | 1 |
| ADI-15664 | 228 | VH1-69 | VK3-11 | ARDRTTAVRYYAMDV | QHRANWPPLT | 38 | 8 | 2 |
| ADI-15665 | 229 | VH1-69 | VK3-11 | ARVGVGRTWVYDIMGYLDY | QHRNNWPSLT | 70 | 20 | 6 |
| ADI-15666 | 230 | VH4-34 | VK3-15 | ARGRGYYGSTTDYRGLHWFDP | QQYNNWPRT | 53 | 22 | 9 |
| ADI-15667 | 231 | VH3-66 | VK3-15 | KDADFWSGAAYNGGYNFDS | QQYHNWPPLT | 2 | 20 | 4 |

TABLE 3

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (ug/ml) subtype A* | Neut $IC_{50}$ (ug/ml) subtype B* |
|---|---|---|---|---|---|---|---|
| ADI-15005 | 124 | 1.398E-09 | 2.36714E-10 | 1.3986E-09 | 2.52685E-10 | 2.159 | 2.533 |
| ADI-15006 | 125 | 3.59777E-09 | 2.43013E-10 | 4.2E-09 | 3.611E-09 | 19.150 | >10 |
| ADI-15555 | 126 | NB | | NB | | 2.188 | 2.454 |
| ADI-15556 | 127 | 1.846E-09 | 2.46853E-10 | 2.199E-09 | 1.90295E-10 | 0.055 | 0.081 |
| ADI-15557 | 128 | 1.34048E-10 | NB | 6.096E-10 | NB | 0.041 | 0.028 |
| ADI-15558 | 129 | 1.564E-09 | NB | 9.401E-10 | NB | | |
| ADI-15559 | 130 | 8.65801E-10 | NB | 9.80392E-10 | NB | 0.008 | 0.006 |
| ADI-15560 | 131 | 2.666E-08 | NB | NB | NB | | |
| ADI-15561 | 132 | 5.5991E-09 | 5.907E-10 | 8.62E-09 | 1.083E-09 | 5.626 | 22.430 |
| ADI-15562 | 133 | 1.8315E-10 | NB | NB | NB | 0.010 | |
| ADI-15563 | 134 | 2.50407E-10 | NB | 2.2E-09 | NB | 0.014 | 0.047 |
| ADI-15564 | 135 | 7.249E-10 | NB | 6.4E-10 | NB | 0.011 | 0.016 |
| ADI-15565 | 136 | 1.6835E-09 | NB | 6.75676E-09 | NB | 21.290 | 6.250 |
| ADI-15566 | 137 | 2.7137E-10 | NB | 2.64236E-10 | NB | 0.010 | 0.043 |
| ADI-15568 | 138 | 4.92247E-10 | NB | 6.99301E-10 | NB | 0.016 | 0.033 |
| ADI-15569 | 139 | 3.07267E-10 | NB | 2.49906E-10 | NB | 0.006 | 0.035 |
| ADI-15570 | 140 | 8.70322E-09 | NB | NB | NB | 13.350 | >10 |
| ADI-15571 | 141 | 2.30229E-09 | NB | 2.568E-08 | NB | 0.541 | 0.430 |
| ADI-15572 | 142 | 3.8994E-09 | NB | NB | NB | 9.480 | 6.250 |
| ADI-15573 | 143 | NB | 1.9802E-10 | NB | 1.98807E-10 | 6.250 | 1.670 |
| ADI-15574 | 144 | 4.0347E-10 | NB | 4.59982E-10 | NB | 0.176 | 0.226 |
| ADI-15575 | 145 | 3.06466E-09 | NB | 4.16146E-09 | NB | >10 | 1.473 |
| ADI-15576 | 146 | NB | 2.36939E-10 | NB | 1.79211E-10 | 6.076 | 9.855 |
| ADI-15577 | 147 | 5.80215E-09 | 7.78816E-10 | 4.65658E-09 | 6.788E-10 | >10 | >10 |
| ADI-15578 | 148 | NB | 1.268E-09 | NB | 1.536E-09 | | |
| ADI-15579 | 149 | NB | | NB | | 8.021 | >10 |
| ADI-15581 | 150 | 5.56328E-09 | NB | NB | NB | 8.249 | 6.125 |
| ADI-15582 | 151 | 4.40238E-09 | 3.8506E-10 | 2.32099E-09 | 2.94942E-10 | 2.216 | 6.738 |
| ADI-15583 | 152 | 3.65965E-10 | NB | 3.5137E-10 | NB | 0.443 | 0.377 |
| ADI-15586 | 153 | 2.80387E-09 | NB | 5.78202E-09 | NB | >10 | 1.020 |
| ADI-15587 | 154 | 1.62602E-09 | NB | 2.41838E-09 | NB | >10 | 0.130 |
| ADI-15588 | 155 | 2.71998E-10 | 3.526E-10 | 4.266E-10 | 9.527E-10 | 0.094 | 0.234 |
| ADI-15589 | 156 | NB | NB | NB | NB | 0.876 | 18.510 |
| ADI-15590 | 157 | 2.273E-08 | NB | NB | NB | >10 | >10 |
| ADI-15591 | 158 | 2.49844E-10 | NB | 3.04044E-10 | NB | 0.086 | 0.219 |
| ADI-15592 | 159 | NB | | 4.82E-08 | | 12.300 | 20.900 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (ug/ml) subtype A* | Neut $IC_{50}$ (ug/ml) subtype B* |
|---|---|---|---|---|---|---|---|
| ADI-15593 | 160 | 4.19024E-09 | 5.07228E-10 | 3.95413E-09 | 7.60746E-10 | >10 | >10 |
| ADI-15594 | 161 | 4.92005E-10 | NB | 5.48847E-10 | NB | 3.250 | 3.280 |
| ADI-15595 | 162 | 8.89284E-10 | NB | NB | NB | 0.020 | 0.170 |
| ADI-15596 | 163 | 5.21E-08 | | 4.755E-08 | | 4.481 | >10 |
| ADI-15597 | 164 | 4.17449E-10 | NB | 6.089E-09 | NB | 0.163 | 1.787 |
| ADI-15599 | 165 | 1.22E-10 | 1.23E-09 | 2.461E-10 | 6.52E-10 | 0.110 | 0.378 |
| ADI-15600 | 166 | 1.709E-09 | 1.62338E-10 | 1.41743E-09 | 1.47601E-09 | 1.309 | 0.958 |
| ADI-15601 | 167 | 3.21234E-10 | 2.0734E-10 | 3.28947E-10 | 1.93237E-10 | 0.046 | 0.084 |
| ADI-15602 | 168 | 7.62777E-10 | NB | 8.07428E-10 | NB | 0.046 | 0.015 |
| ADI-15603 | 169 | 3.76081E-09 | NB | 6.9735E-09 | 1.192E-08 | 0.795 | 0.273 |
| ADI-15604 | 170 | 4.302E-10 | NB | 4.60087E-10 | 1.76835E-09 | 0.081 | 0.082 |
| ADI-15605 | 171 | 1.38122E-09 | 1.62999E-10 | 3.487E-09 | 1.7094E-10 | >10 | >10 |
| ADI-15606 | 172 | 3.40832E-09 | NB | 5.75209E-09 | 5.88755E-09 | >10 | 0.802 |
| ADI-15607 | 173 | 6.689E-08 | NB | NB | NB | >10 | >10 |
| ADI-15609 | 174 | 5.21512E-10 | NB | 6.28141E-10 | NB | 0.022 | >10 |
| ADI-15610 | 175 | 8.23723E-10 | 4.17101E-10 | NB | NB | 0.727 | >10 |
| ADI-15611 | 176 | 5.78704E-09 | 6.2637E-10 | 4.34028E-09 | 6.09385E-10 | 0.150 | 0.432 |
| ADI-15612 | 177 | 1.56006E-10 | 4.164E-10 | 1.5674E-10 | 3.528E-10 | 0.053 | 0.164 |
| ADI-15613 | 178 | 4.79157E-09 | NB | NB | NB | 0.862 | 3.038 |
| ADI-15614 | 179 | 4.09668E-10 | NB | 4.65658E-10 | NB | 0.027 | 0.059 |
| ADI-15615 | 180 | 6.02954E-10 | NB | 1.164E-08 | NB | 0.977 | 1.675 |
| ADI-15616 | 181 | 2.09622E-09 | NB | 1.73762E-09 | NB | 4.520 | 5.578 |
| ADI-15617 | 182 | 6.84697E-10 | NB | 7.1048E-10 | NB | 0.022 | 0.038 |
| ADI-15618 | 183 | 4.36681E-10 | NB | 5.35189E-10 | NB | 0.003 | |
| ADI-15619 | 184 | 2.66134E-09 | 1.757E-09 | 6.913E-09 | 2.209E-09 | 1.453 | 0.377 |
| ADI-15620 | 185 | 2.702E-10 | NB | 1.404E-09 | NB | 0.077 | 0.053 |
| ADI-15621 | 186 | 5.97015E-10 | NB | 5.54785E-10 | NB | 0.018 | 0.021 |
| ADI-15622 | 187 | 1.39276E-09 | NB | 1.50943E-09 | NB | 0.544 | 1.367 |
| ADI-15623 | 188 | 3.8219E-10 | NB | 4.35256E-10 | NB | 0.054 | 0.108 |
| ADI-15624 | 189 | 3.91083E-10 | NB | 4.07332E-10 | NB | 0.051 | 0.033 |
| ADI-15625 | 190 | 2.73E-10 | NB | 2.614E-09 | NB | 0.239 | 1.198 |
| ADI-15626 | 191 | 3.33778E-09 | 5.46001E-10 | 3.38926E-09 | 6.53168E-10 | 14.180 | >10 |
| ADI-15627 | 192 | 3.536E-09 | 1.57729E-10 | 1.61E-09 | 1.36519E-10 | 2.173 | 2.416 |
| ADI-15628 | 193 | 1.541E-10 | 2.46731E-09 | 6.595E-10 | NB | 0.014 | 0.034 |
| ADI-15629 | 194 | 3.4825E-10 | 2.28128E-10 | 3.59648E-10 | 2.13379E-10 | 0.085 | 0.088 |
| ADI-15630 | 195 | 5.67215E-09 | NB | NB | NB | >10 | 6.643 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (ug/ml) subtype A* | Neut $IC_{50}$ (ug/ml) subtype B* |
|---|---|---|---|---|---|---|---|
| ADI-15631 | 196 | 3.6846E−10 | NB | 5.52334E−10 | NB | 0.099 | 0.207 |
| ADI-15632 | 197 | 2.15308E−09 | 2.245E−09 | 2.94E−08 | | 1.416 | 5.719 |
| ADI-15633 | 198 | 1.18343E−09 | 1.03681E−10 | 8.95656E−10 | 1.10865E−10 | 12.780 | >10 |
| ADI-15634 | 199 | 5.974E−09 | NB | NB | NB | >10 | >10 |
| ADI-15635 | 200 | 3.85951E−10 | NB | 4.31499E−10 | NB | 0.115 | 0.226 |
| ADI-15636 | 201 | 6.29327E−09 | NB | NB | NB | >10 | 6.444 |
| ADI-15637 | 202 | 3.51309E−09 | NB | 6.12933E−09 | NB | 0.357 | 1.053 |
| ADI-15638 | 203 | 3.69754E−10 | NB | 4.01606E−10 | NB | 0.178 | >10 |
| ADI-15640 | 204 | 2.51604E−10 | 1.69348E−10 | 1.49365E−09 | 1.95886E−10 | >10 | 4.819 |
| ADI-15641 | 205 | 1.2945E−10 | 1.60772E−10 | 1.35962E−10 | 1.36333E−10 | 0.184 | 0.483 |
| ADI-15642 | 206 | 1.281E−09 | NB | 2.813E−09 | NB | 0.499 | 0.005 |
| ADI-15643 | 207 | 1.5163E−10 | NB | 1.62338E−10 | NB | 0.039 | 0.115 |
| ADI-15644 | 208 | NB | 3.00616E−10 | NB | 1.94363E−10 | >10 | >10 |
| ADI-15645 | 209 | 8.7146E−09 | 3.67377E−10 | 4.60299E−09 | 3.52051E−10 | >10 | >10 |
| ADI-15646 | 210 | 3.758E−09 | 3.17561E−10 | 2.61712E−09 | 3.178E−09 | 0.846 | >10 |
| ADI-15647 | 211 | 7.823E−09 | NB | NB | NB | >10 | >10 |
| ADI-15648 | 212 | 3.9116E−10 | NB | 4.37541E−10 | NB | 0.064 | 0.145 |
| ADI-15649 | 213 | 3.19336E−10 | NB | 3.29327E−10 | NB | >10 | 2.195 |
| ADI-15650 | 214 | 1.671E−09 | NB | 3.52E−09 | NB | 8.297 | 0.016 |
| ADI-15651 | 215 | 1.72414E−09 | 2.29568E−10 | 2.08182E−09 | 4.531E−10 | 1.605 | 3.287 |
| ADI-15652 | 216 | 1.42E−10 | 4.98256E−09 | 3.77E−10 | NB | 0.012 | 0.036 |
| ADI-15653 | 217 | NB | 3.11769E−10 | NB | 3.89636E−10 | >10 | >10 |
| ADI-15654 | 218 | 5.49E−09 | NB | 4.47327E−09 | NB | 3.758 | 3.272 |
| ADI-15655 | 219 | 3.562E−08 | NB | 8.577E−09 | NB | >10 | >10 |
| ADI-15656 | 220 | 3.27761E−09 | NB | 6.12933E−09 | NB | >10 | 0.021 |
| ADI-15657 | 221 | 5.65291E−09 | NB | NB | NB | >10 | >10 |
| ADI-15658 | 222 | 3.35627E−09 | 1.79695E−10 | 1.80832E−09 | 1.69062E−10 | 6.250 | >10 |
| ADI-15659 | 223 | 4.88759E−09 | 1.13E−09 | 1.105E−08 | 3.657E−09 | >10 | >10 |
| ADI-15660 | 224 | 1.06157E−09 | 9.80392E−11 | 8.90076E−10 | 1.04932E−10 | 17.340 | >10 |
| ADI-15661 | 225 | 5.21105E−10 | NB | NB | NB | 0.021 | >10 |
| ADI-15662 | 226 | 1.575E−08 | 3.086E−09 | NB | | 6.250 | >10 |
| ADI-15663 | 227 | 2.64166E−10 | 2.316E−09 | 2.86738E−10 | NB | 0.003 | 0.019 |
| ADI-15664 | 228 | 3.662E−09 | NB | NB | NB | >10 | >10 |
| ADI-15665 | 229 | 8.253E−09 | NB | NB | NB | 12.720 | 6.250 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (ug/ml) subtype A* | Neut $IC_{50}$ (ug/ml) subtype B* |
|---|---|---|---|---|---|---|---|
| ADI-15666 | 230 | NB | 4.98504E−10 | NB | 5.46299E−10 | 1.407 | >10 |
| ADI-15667 | 231 | 3.23415E−10 | 2.31134E−10 | 3.33278E−10 | 2.08442E−10 | 0.039 | 0.048 |

*NN; non-neutralizing, NB; non-binding, ND; not determined.

IgG KDs were calculated for antibodies with BLI binding responses > 0.1 nm. Antibodies with BLI binding responses < 0.05 nm were designated as NB.

TABLE 4

Bin, patch, and antigenic site assignments for anti-RSV antibodies

| Name | Antibody number (Ab #) | Bin Assignment | Patch Assignment | Antigenic Site Assignment |
|---|---|---|---|---|
| ADI-15005 | 124 | Site I Ab | 8 | I |
| ADI-15006 | 125 | Site I Ab | | |
| ADI-15555 | 126 | Mota | | |
| ADI-15556 | 127 | Mota | 5, 6 | III |
| ADI-15557 | 128 | High Affinity Ab. 1 | | IV |
| ADI-15558 | 129 | D25 | 2, 1 | Ø |
| ADI-15559 | 130 | D25 | 2, 1 | Ø |
| ADI-15560 | 131 | 101F | | |
| ADI-15561 | 132 | Site I Ab | | |
| ADI-15562 | 133 | D25 | 2, 1 | Ø |
| ADI-15563 | 134 | D25/mota/MPE8 | 4, 2 | V |
| ADI-15564 | 135 | D25 | 1, 2 | Ø |
| ADI-15565 | 136 | Unknown | 2 | UK |
| ADI-15566 | 137 | D25/mota/MPE8 | 2, 4 | V |
| ADI-15568 | 138 | D25/mota | 4, 2, 1 | V |
| ADI-15569 | 139 | D25/mota/MPE8 | 4, 2 | V |
| ADI-15570 | 140 | AM14 | | |
| ADI-15571 | 141 | High Affinity Ab. 1 | | |
| ADI-15572 | 142 | AM14 | | |
| ADI-15573 | 143 | Unknown | | |
| ADI-15574 | 144 | MPE8 | 2** | III |
| ADI-15575 | 145 | Unknown | | |
| ADI-15576 | 146 | 101F | | |
| ADI-15577 | 147 | High Affinity Ab. 2 | | |
| ADI-15578 | 148 | 101F | | |
| ADI-15579 | 149 | Unknown | | |
| ADI-15581 | 150 | MPE8 | | |
| ADI-15582 | 151 | Mota/101F | | |
| ADI-15583 | 152 | High Affinity Ab. 1 | 8 | IV |
| ADI-15586 | 153 | Unknown | | |
| ADI-15587 | 154 | Unknown | 2, 1 | Ø |
| ADI-15588 | 155 | Mota | 5 | II |
| ADI-15589 | 156 | Unknown | | |
| ADI-15590 | 157 | Mota | | |
| ADI-15591 | 158 | Mota/MPE8 | 2** | III |
| ADI-15592 | 159 | Unknown | | |
| ADI-15593 | 160 | 101F/Site I Ab | | |
| ADI-15594 | 161 | | 2, 1 | Ø |
| ADI-15595 | 162 | D25 | 2, 1 | Ø |
| ADI-15596 | 163 | 101F | | |
| ADI-15597 | 164 | Mota/MPE8 | 2, 1* | III |
| ADI-15599 | 165 | High Affinity Ab. 1 | 9 | IV |
| ADI-15600 | 166 | 101F | 6, 8, 7 | I |
| ADI-15601 | 167 | Mota | 5 | II |
| ADI-15602 | 168 | D25 | 2, 1 | Ø |
| ADI-15603 | 169 | Mota | | |
| ADI-15604 | 170 | Mota/MPE8 | 2, 1** | III |
| ADI-15605 | 171 | 101F | 6, 9 | III |
| ADI-15606 | 172 | Mota | | |
| ADI-15607 | 173 | AM14 | | |
| ADI-15609 | 174 | D25/mota | 4 | V |
| ADI-15610 | 175 | Site I Ab | | I |
| ADI-15611 | 176 | Unknown | | |
| ADI-15612 | 177 | High Affinity Ab. 1 | | IV |
| ADI-15613 | 178 | AM14 | | |
| ADI-15614 | 179 | MPE8 | | III |
| ADI-15615 | 180 | Mota/MPE8 | | III |
| ADI-15616 | 181 | AM14 | | |
| ADI-15617 | 182 | D25 | 2, 1 | Ø |
| ADI-15618 | 183 | D25 | | Ø |
| ADI-15619 | 184 | Unknown | | |
| ADI-15620 | 185 | High Affinity Ab. 1 | 9 | IV |
| ADI-15621 | 186 | D25 | 1 | Ø |
| ADI-15622 | 187 | MPE8 | 4 | V |
| ADI-15623 | 188 | MPE8 | | III |
| ADI-15624 | 189 | Mota/MPE8 | | III |
| ADI-15625 | 190 | High Affinity Ab. 2 | | I |
| ADI-15626 | 191 | Unknown | | |
| ADI-15627 | 192 | 101F | | |
| ADI-15628 | 193 | High Affinity Ab. 1 | 9 | IV |
| ADI-15629 | 194 | Mota | 5 | II |
| ADI-15630 | 195 | AM14 | | |
| ADI-15631 | 196 | D25 | 4, 1 | V |
| ADI-15632 | 197 | Mota/Site I Ab | | |
| ADI-15633 | 198 | 101F | | IV |
| ADI-15634 | 199 | AM14 | | |
| ADI-15635 | 200 | Mota/MPE8 | | III |
| ADI-15636 | 201 | AM14 | | |
| ADI-15637 | 202 | 101F | | |
| ADI-15638 | 203 | Mota/MPE8 | | III |
| ADI-15640 | 204 | High Affinity Ab. 2 | | I |
| ADI-15641 | 205 | High Affinity Ab. 1 | 9 | IV |
| ADI-15642 | 206 | D25 | 1, 2 | Ø |
| ADI-15643 | 207 | High Affinity Ab. 1 | 8 | IV |
| ADI-15644 | 208 | MPE8/101F | | |
| ADI-15645 | 209 | Unknown | | |
| ADI-15646 | 210 | Site I Ab | | |
| ADI-15647 | 211 | Mota/MPE8 | | |
| ADI-15648 | 212 | Mota/MPE8 | | III |
| ADI-15649 | 213 | Mota/MPE8 | | III |
| ADI-15650 | 214 | D25 | 1, 2 | Ø |
| ADI-15651 | 215 | Site I Ab | 9 | I |
| ADI-15652 | 216 | High Affinity Ab. 1 | 9 | IV |
| ADI-15653 | 217 | 101F | | |
| ADI-15654 | 218 | 101F | | |
| ADI-15655 | 219 | Unknown | | |
| ADI-15656 | 220 | Unknown | | |
| ADI-15657 | 221 | MPE8 | | |
| ADI-15658 | 222 | Mota | | |
| ADI-15659 | 223 | Site I Ab | | |
| ADI-15660 | 224 | 101F | 9 | IV |
| ADI-15661 | 225 | D25 | 4, 3, 1 | V |
| ADI-15662 | 226 | Mota | | |
| ADI-15663 | 227 | Mota/MPE8 | | III |
| ADI-15664 | 228 | AM14 | | |

TABLE 4-continued

Bin, patch, and antigenic site assignments for anti-RSV antibodies

| Name | Antibody number (Ab #) | Bin Assignment | Patch Assignment | Antigenic Site Assignment |
|---|---|---|---|---|
| ADI-15665 | 229 | Mota/MPE8 | | |
| ADI-15666 | 230 | MPE8/101F | | |
| ADI-15667 | 231 | Unknown | 5 | II |

**Two site III antibodies displayed weakly disrupted binding for patches 1 and/or 2. This disruption was much weaker than was what observed for D25 competitors.

TABLE 5

A subset of anti-RSV F antibodies cross-neutralize human metapneumovirus.

| Name | Antibody number (Ab #) | HMPV-A1 $IC_{50}$ (µg/ml) | RSV-A2 $IC_{50}$ (µg/ml) | Prefusion RSV F $K_D$ (M) | Postfusion RSV F $K_D$ (M) | RSV F Binding Site |
|---|---|---|---|---|---|---|
| ADI-15614 | 179 | 0.22 | 0.03 | $4.1 \times 10^{-10}$ | N.B. | III |
| ADI-15657 | 221 | 11.9 | >25 | $5.7 \times 10^{-9}$ | N.B. | III* |
| ADI-15665 | 229 | 13.5 | 12.7 | $8.3 \times 10^{-9}$ | N.B. | III* |
| ADI-15647 | 211 | 20.3 | >25 | $7.8 \times 10^{-9}$ | N.B. | III* |
| ADI-15623 | 188 | 0.37 | 0.05 | $2.1 \times 10^{-9}$ | N.B. | III* |
| MPE8 Control | N/A | 0.07 | 0.04 | — | — | — |

N.B., non-binder; N/A, not applicable
*Binding site assignment based on competition only.

Materials and Methods

Study Design

To profile the antibody response to RSV F, peripheral blood mononuclear cells were obtained from an adult donor approximately between 20-35 years of age, and monoclonal antibodies from RSV F-reactive B cells were isolated therefrom. The antibodies were characterized by sequencing, binding, epitope mapping, and neutralization assays. All samples for this study were collected with informed consent of volunteers. This study was unblinded and not randomized. At least two independent experiments were performed for each assay.

Generation of RSV F Sorting Probes

The soluble prefusion and postfusion probes were based on the RSV F ΔFP and DS-Cav1 constructs that we previously crystallized and determined to be in the pre- and postfusion conformations, respectively (11, 15). To increase the avidity of the probes and to uniformly orient the RSV F proteins, the trimeric RSV F proteins were coupled to tetrameric streptavidin through biotinylation of a C-terminal AviTag. For each probe, both a C-terminal His-Avi tagged version and a C-terminal StrepTagII version were co-transfected into FreeStyle 293-F cells. The secreted proteins were purified first over Ni-NTA resin to remove trimers lacking the His-Avi tag. The elution from the Ni-NTA purification was then purified over Strep-Tactin resin. Due to the low avidity of a single StrepTagII for the Strep-Tactin resin, additional washing steps were able to remove singly StrepTagged trimers. This resulted in the purification of trimers containing two StrepTagII tagged monomers and therefore only one His-Avi tagged monomer. This purification scheme results in a single AviTag per trimer which greatly reduces the aggregation or 'daisy-chaining' that occurs when trimeric proteins containing three AviTags are incubated with tetrameric streptavidin. RSV F trimers were biotinylated using biotin ligase BirA according to the manufacturer's instructions (Avidity, LLC). Biotinylated proteins were separated from excess biotin by size-exclusion chromatography on a Superdex 200 column (GE Healthcare). Quantification of the number of biotin moieties per RSV F trimer was performed using the Quant*Tag Biotin Kit per the manufacturer's instructions (Vector Laboratories).

Single B-Cell Sorting

Peripheral blood mononuclear cells were stained using anti-human IgG (BV605), IgA (FITC), CD27 (BV421), CD8 (PerCP-Cy5.5), CD14 (PerCP-Cy5.5), CD19 (PECy7), CD20 (PECy7) and a mixture of dual-labeled DS-Cav1 and F ΔFP tetramers (50 nM each). Dual-labeled RSV F tetramers were generated by incubating the individual AviTagged RSV F proteins with premium-grade phycoerythrin-labeled streptavidin (Molecular Probes) or premium-grade allophycocyanin-labeled streptavidin for at least 20 minutes on ice at a molar ratio of 4:1. Tetramers were prepared fresh for each experiment. Single cells were sorted on a BD fluorescence-activated cell sorter Aria II into 96-well PCR plates (BioRad) containing 20 µL/well of lysis buffer [5 µL of 5× first strand cDNA buffer (Invitrogen), 0.25 µL RNaseOUT (Invitrogen), 1.25 µL dithiothreitol (Invitrogen), 0.625 µL NP-40 (New England Biolabs), and 12.6 µL dH$_2$O]. Plates were immediately frozen on dry ice before storage at −80° C.

Amplification and Cloning of Antibody Variable Genes

Single B cell PCR was performed as described previously (22). Briefly, IgH, Igλ and Igκ variable genes were amplified by RT-PCR and nested PCR reactions using cocktails of IgG and IgA-specific primers (22). The primers used in the second round of PCR contained 40 base pairs of 5' and 3' homology to the cut expression vectors to allow for cloning by homologous recombination into *Saccharomyces cerevisiae* (40). PCR products were cloned into *S. cerevisiae* using the lithium acetate method for chemical transformation (41). Each transformation reaction contained 20 µL of unpurified heavy chain and light chain PCR product and 200 ng of cut heavy and light chain plasmids. Following transformation, individual yeast colonies were picked for sequencing and characterization.

Expression and Purification of IgGs and Fab Fragments

Anti-RSV F IgGs were expressed in *S. cerevisiae* cultures grown in 24-well plates, as described previously (23). Fab fragments used for competition assays were generated by digesting the IgGs with papain for 2 hours at 30° C. The digestion was terminated by the addition of iodoacetamide, and the Fab and Fc mixtures were passed over Protein A agarose to remove Fc fragments and undigested IgG. The flowthrough of the Protein A resin was then passed over CaptureSelect™ IgG-CH1 affinity resin (ThermoFischer Scientific), and eluted with 200 mM acetic acid/50 mM NaCl pH 3.5 into ⅛th volume 2M Hepes pH 8.0. Fab fragments then were buffer-exchanged into PBS pH 7.0.

Biolayer Interferometry Binding Analysis

IgG binding to DS-Cav1 and FΔ FP was determined by BLI measurements using a FortéBio Octet HTX instrument (Pall Life Sciences). For high-throughput $K_D$ screening, IgGs were immobilized on AHQ sensors (Pall Life Sciences) and exposed to 100 nM antigen in PBS containing 0.1% BSA (PBSF) for an association step, followed by a dissociation step in PBSF buffer. Data was analyzed using the ForteBio Data Analysis Software 7. The data was fit to a 1:1 binding model to calculate an association and dissociation rate, and $K_D$ was calculated using the ratio $k_d/k_a$.

Antibody Competition Assays

Antibody competition assays were performed as previously described (23). Antibody competition was measured by the ability of a control anti-RSV F Fab to inhibit binding of yeast surface-expressed anti-RSV F IgGs to either DS-Cav1 or FΔ FP. 50 nM biotinylated DS-Cav1 or FΔ FP was pre-incubated with 1 μM competitor Fab for 30 min at room temperature and then added to a suspension of yeast expressing anti-RSV F IgG. Unbound antigen was removed by washing with PBS containing 0.1% BSA (PB SF). After washing, bound antigen was detected using streptavidin Alexa Fluor 633 at a 1:500 dilution (Life Technologies) and analyzed by flow cytometry using a FACSCanto II (BD Biosciences). The level of competition was assessed by measuring the fold reduction in antigen binding in the presence of competitor Fab relative to an antigen-only control. Antibodies were considered competitors when a greater than five-fold reduction was observed in the presence of control Fab relative to an antigen-only control.

Expression, Purification and Biotinylation of preF Patch Variants

A panel of 9 patches of 2-4 mutations uniformly covering the surface of the preF molecule was designed based on the structure of prefusion RSV F (10). For known antigenic sites, including those recognized by motavizumab, 101F, D25, AM14 and MPEG, patches incorporated residues associated with viral escape or known to be critical for antibody binding. Residues with high conservation across 184 subtype A, subtype B and bovine RSV F sequences were avoided where possible to minimize the likelihood of disrupting protein structure. The mutations present in each patch variant are shown in FIG. 7A. Mutations for each patch variant were cloned into the prefusion stabilized RSV F (DS-Cav1) construct with a C-terminal AviTag for site specific biotinylation. Proteins were secreted from FreeStyle 293-F cells, purified over Ni-NTA resin and biotinylated using biotin ligase BirA according to the manufacturer's instructions (Avidity, LLC). Biotinylated proteins were separated from excess biotin by size-exclusion chromatography on a Superdex 200 column (GE Healthcare). A deglycosylated version of DS-Cav1 was produced by expressing DS-Cav1 in the presence of 1 μM kifunensine and digesting with 10% (wt/wt) EndoH before biotinylation.

Luminex Assay for Patch Variant Binding

Binding of isolated antibodies to the patch variants was determined using a high-throughput Luminex assay. Each biotinylated variant and a DS-Cav1 control were coupled to avidin coated MagPlex beads (Bio-Rad), each with a bead identification number reflecting a unique ratio of red and infrared dyes embedded within the bead. The coupled beads were then mixed with a six-fold serial dilution of each antibody, ranging from 400 nM to 1.4 pM, in a 384-well plate. Beads were washed using a magnetic microplate washer (BioTek) before incubation with a PE conjugated mouse anti-human IgG Fc secondary antibody (Southern Biotech). Beads were classified and binding of PE was measured using a FLEXMAP 3D flow cytometer (Luminex).

RSV Neutralization Assays

Viral stocks were prepared and maintained as previously described (61). Recombinant mKate-RSV expressing prototypic subtype A (strain A2) and subtype B (18537) F genes and the Katushka fluorescent protein were constructed as reported by Hotard et al. (62). HEp-2 cells were maintained in Eagle's minimal essential medium containing 10% fetal bovine serum supplemented with glutamine, penicillin and streptomycin. Antibody neutralization was measured by a fluorescence plate reader neutralization assay (15). A 30 μL solution of culture media containing $2.4\times10^4$ HEp-2 cells was seeded in 384-well black optical bottom plate (Nunc, Thermo Scientific). IgG samples were serially diluted four-fold from 1:10 to 1:163840 and an equal volume of recombinant mKate-RSV A2 was added. Samples were mixed and incubated at 37° C. for one hour. After incubation, 50 μL mixture of sample and virus was added to cells in 384-well plate, and incubated at 37° C. for 22-24 hours. The assay plate was then measured for fluorescence intensity in a microplate reader at Ex 588 nm and Em 635 nm (SpectraMax Paradigm, molecular devices). $IC_{50}$ of neutralization for each sample was calculated by curve fitting using Prism (GraphPad Software Inc.).

Human Metapneuomovirus Neutralization Assays

Predetermined amounts of GFP-expressing hMPV recombinant virus (NL/1/00, A1 sublineage, a kind gift of Bernadette van den Hoogen and Ron Fouchier, Rotterdam, the Netherlands) were mixed with serial dilutions of monoclonal antibodies before being added to cultures of Vero-118 cells growing in 96-well plates with Dulbecco's Modified Eagle's medium supplemented with 10% fetal calf serum. Thirty-six hours later, the medium was removed, PBS was added and the amount of GFP per well was measured with a Tecan microplate reader M200. Fluorescence values were represented as percent of a virus control without antibody.

Polyreactivity Assay

Antibody polyreactivity was assessed using a previously described high-throughput assay that measures binding to solubilized CHO cell membrane preparations (SMPs) (43). Briefly, two million IgG-presenting yeast were transferred into a 96-well assay plate and pelleted to remove the supernatant. The pellet was resuspended in 50 μL of 1:10 diluted stock b-SMPs and incubated on ice for 20 minutes. Cells were then washed twice with ice-cold PBSF and the cell pellet was re-suspended in 50 μL of secondary labeling mix (Extravidin-R-PE, anti-human LCFITC, and propidium iodide). The mix was incubated on ice for 20 minutes followed by two washes with ice-cold PBSF. Cells were then re-suspended in 100 μL of ice-cold PB SF, and the plate was run on a FACSCanto II (BD Biosciences) using a HTS sample injector. Flow cytometry data was analyzed for mean fluorescence intensity in the R-PE channel and normalized to proper controls in order to assess non-specific binding.

REFERENCES AND NOTES

1. A. L. Rogovik, B. Carleton, A. Solimano, R. D. Goldman, Palivizumab for the prevention of respiratory syncytial virus infection. *Can Fam Physician* 56, 769-772 (2010).

2. B. S. Graham, Biological challenges and technological opportunities for respiratory syncytial virus vaccine development. *Immunol Rev* 239, 149-166 (2011).

3. J. R. Groothuis, E. A. Simoes, V. G. Hemming, Respiratory syncytial virus (RSV) infection in preterm infants and the protective effects of RSV immune globulin (RSVIG). Respiratory Syncytial Virus Immune Globulin Study Group. *Pediatrics* 95, 463-467 (1995).

4. M. Magro, V. Mas, K. Chappell, M. Vazquez, O. Cano, D. Luque, M. C. Terron, J. A. Melero, C. Palomo, Neutralizing antibodies against the preactive form of respiratory syncytial virus fusion protein offer unique possibilities for clinical intervention. *Proc Natl Acad Sci USA* 109, 3089-3094 (2012).

5. S. Johnson, C. Oliver, G. A. Prince, V. G. Hemming, D. S. Pfarr, S. C. Wang, M. Dormitzer, J. O'Grady, S. Koenig, J. K. Tamura, R. Woods, G. Bansal, D. Couchenour, E. Tsao, W. C. Hall, J. F. Young, Development of a humanized monoclonal antibody (MEDI-493) with potent in vitro and in vivo activity against respiratory syncytial virus. *J Infect Dis* 176, 1215-1224 (1997).

6. J. A. Beeler, K. van Wyke Coelingh, Neutralization epitopes of the F glycoprotein of respiratory syncytial virus: effect of mutation upon fusion function. *J Virol* 63, 2941-2950 (1989).

7. R. A. Karron, D. A. Buonagurio, A. F. Georgiu, S. S. Whitehead, J. E. Adamus, M. L. Clements-Mann, D. O. Harris, V. B. Randolph, S. A. Udem, B. R. Murphy, M. S. Sidhu, Respiratory syncytial virus (RSV) SH and G proteins are not essential for viral replication in vitro: clinical evaluation and molecular characterization of a cold-passaged, attenuated RSV subgroup B mutant. *Proc Natl Acad Sci USA* 94, 13961-13966 (1997).

8. J. O. Ngwuta, M. Chen, K. Modjarrad, M. G. Joyce, M. Kanekiyo, A. Kumar, H. M. Yassine, S. M. Moin, A. M. Killikelly, G. Y. Chuang, A. Druz, I. S. Georgiev, E. J. Rundlet, M. Sastry, G. B. Stewart-Jones, Y. Yang, B. Zhang, M. C. Nason, C. Capella, M. E. Peeples, J. E. Ledgerwood, J. S. McLellan, P. D. Kwong, B. S. Graham, Prefusion F-specific antibodies determine the magnitude of RSV neutralizing activity in human sera. *Sci Transl Med* 7, 309ra162 (2015).

9. T. I.-R. S. Group, Palivizumab, a humanized respiratory syncytial virus monoclonal antibody, reduces hospitalization from respiratory syncytial virus infection in high-risk infants. *Pediatrics* 102, 531-537 (1998).

10. J. S. McLellan, M. Chen, S. Leung, K. W. Graepel, X. Du, Y. Yang, T. Zhou, U. Baxa, E. Yasuda, T. Beaumont, A. Kumar, K. Modjarrad, Z. Zheng, M. Zhao, N. Xia, P. D. Kwong, B. S. Graham, Structure of RSV fusion glycoprotein trimer bound to a prefusion-specific neutralizing antibody. *Science* 340, 1113-1117 (2013).

11. J. S. McLellan, Y. Yang, B. S. Graham, P. D. Kwong, Structure of respiratory syncytial virus fusion glycoprotein in the postfusion conformation reveals preservation of neutralizing epitopes. *J Virol* 85, 7788-7796 (2011).

12. K. A. Swanson, E. C. Settembre, C. A. Shaw, A. K. Dey, R. Rappuoli, C. W. Mandl, P. R. Dormitzer, A. Carfi, Structural basis for immunization with postfusion respiratory syncytial virus fusion F glycoprotein (RSV F) to elicit high neutralizing antibody titers. *Proc Natl Acad Sci USA* 108, 9619-9624 (2011).

13. L. Liljeroos, M. A. Krzyzaniak, A. Helenius, S. J. Butcher, Architecture of respiratory syncytial virus revealed by electron cryotomography. *Proc Natl Acad Sci USA* 110, 11133-11138 (2013).

14. A. Krarup, D. Truan, P. Furmanova-Hollenstein, L. Bogaert, P. Bouchier, I. J. Bisschop, M. N. Widjojoatmodjo, R. Zahn, H. Schuitemaker, J. S. McLellan, J. P. Langedijk, A highly stable prefusion RSV F vaccine derived from structural analysis of the fusion mechanism. *Nat Commun* 6, 8143 (2015).

15. J. S. McLellan, M. Chen, M. G. Joyce, M. Sastry, G. B. Stewart-Jones, Y. Yang, B. Zhang, L. Chen, S. Srivatsan, A. Zheng, T. Zhou, K. W. Graepel, A. Kumar, S. Moin, J. C. Boyington, G. Y. Chuang, C. Soto, U. Baxa, A. Q. Bakker, H. Spits, T. Beaumont, Z. Zheng, N. Xia, S. Y. Ko, J. P. Todd, S. Rao, B. S. Graham, P. D. Kwong, Structure-based design of a fusion glycoprotein vaccine for respiratory syncytial virus. *Science* 342, 592-598 (2013).

16. M. J. Kwakkenbos, S. A. Diehl, E. Yasuda, A. Q. Bakker, C. M. van Geelen, M. V. Lukens, G. M. van Bleek, M. N. Widjojoatmodjo, W. M. Bogers, H. Mei, A. Radbruch, F. A. Scheeren, H. Spits, T. Beaumont, Generation of stable monoclonal antibody-producing B cell receptor-positive human memory B cells by genetic programming. *Nat Med* 16, 123-128 (2010).

17. D. Corti, S. Bianchi, F. Vanzetta, A. Minola, L. Perez, G. Agatic, B. Guarino, C. Silacci, J. Marcandalli, B. J. Marsland, A. Piralla, E. Percivalle, F. Sallusto, F. Baldanti, A. Lanzavecchia, Cross-neutralization of four paramyxoviruses by a human monoclonal antibody. *Nature* 501, 439-443 (2013).

18. M. Magro, D. Andreu, P. Gomez-Puertas, J. A. Melero, C. Palomo, Neutralization of human respiratory syncytial virus infectivity by antibodies and low-molecular-weight compounds targeted against the fusion glycoprotein. *J Virol* 84, 7970-7982 (2010).

19. G. Taylor, E. J. Stott, J. Furze, J. Ford, P. Sopp, Protective epitopes on the fusion protein of respiratory syncytial virus recognized by murine and bovine monoclonal antibodies. *J Gen Virol* 73 (Pt 9), 2217-2223 (1992).

20. L. J. Calder, L. Gonzalez-Reyes, B. Garcia-Barreno, S. A. Wharton, J. J. Skehel, D. C. Wiley, J. A. Melero, Electron microscopy of the human respiratory syncytial virus fusion protein and complexes that it forms with monoclonal antibodies. *Virology* 271, 122-131 (2000).

21. M. S. Gilman, S. M. Moin, V. Mas, M. Chen, N. K. Patel, K. Kramer, Q. Zhu, S. C. Kabeche, A. Kumar, C. Palomo, T. Beaumont, U. Baxa, N. D. Ulbrandt, J. A. Melero, B. S. Graham, J. S. McLellan, Characterization of a Prefusion-Specific Antibody That Recognizes a Quaternary, Cleavage-Dependent Epitope on the RSV Fusion Glycoprotein. *PLoS Pathog* 11, e1005035 (2015).

22. M. G. Joyce, A. K. Wheatley, P. V. Thomas, G. Y. Chuang, C. Soto, R. T. Bailer, A. Druz, I. S. Georgiev, R. A. Gillespie, M. Kanekiyo, W. P. Kong, K. Leung, S. N. Narpala, M. S. Prabhakaran, E. S. Yang, B. Zhang, Y. Zhang, M. Asokan, J. C. Boyington, T. Bylund, S. Darko, C. R. Lees, A. Ransier, C. H. Shen, L. Wang, J. R. Whittle, X. Wu, H. M. Yassine, C. Santos, Y. Matsuoka, Y. Tsybovsky, U. Baxa, J. C. Mullikin, K. Subbarao, D. C. Douek, B. S. Graham, R. A. Koup, J. E. Ledgerwood, M. Roederer, L. Shapiro, P. D. Kwong, J. R. Mascola, A. B. McDermott, Vaccine-Induced Antibodies that Neutralize Group 1 and Group 2 Influenza A Viruses. *Cell* 166, 609-623 (2016).

23. J. Truck, M. N. Ramasamy, J. D. Galson, R. Rance, J. Parkhill, G. Lunter, A. J. Pollard, D. F. Kelly, Identification of antigen-specific B cell receptor sequences using public repertoire analysis. *J Immunol* 194, 252-261 (2015).

24. P. Parameswaran, Y. Liu, K. M. Roskin, K. K. Jackson, V. P. Dixit, J. Y. Lee, K. L. Artiles, S. Zompi, M. J. Vargas, B. B. Simen, B. Hanczaruk, K. R. McGowan, M. A. Tariq, N. Pourmand, D. Koller, A. Balmaseda, S. D. Boyd, E. Harris, A. Z. Fire, Convergent antibody signatures in human dengue. *Cell host & microbe* 13, 691-700 (2013).

25. K. J. Jackson, Y. Liu, K. M. Roskin, J. Glanville, R. A. Hoh, K. Seo, E. L. Marshall, T. C. Gurley, M. A. Moody, B. F. Haynes, E. B. Walter, H. X. Liao, R. A. Albrecht, A. Garcia-Sastre, J. Chaparro-Riggers, A. Rajpal, J. Pons, B. B. Simen, B. Hanczaruk, C. L. Dekker, J. Laserson, D. Koller, M. M. Davis, A. Z. Fire, S. D. Boyd, Human responses to influenza vaccination show seroconversion signatures and convergent antibody rearrangements. *Cell host & microbe* 16, 105-114 (2014).

26. F. W. Henderson, A. M. Collier, W. A. Clyde, Jr., F. W. Denny, Respiratory-syncytial-virus infections, reinfections and immunity. A prospective, longitudinal study in young children. *The New England journal of medicine* 300, 530-534 (1979).

27. M. A. Moody, B. F. Haynes, Antigen-specific B cell detection reagents: use and quality control. *Cytometry A* 73, 1086-1092 (2008).

28. M. S. Habibi, A. Jozwik, S. Makris, J. Dunning, A. Paras, J. P. DeVincenzo, C. A. de Haan, J. Wrammert, P. J. Openshaw, C. Chiu, I. Mechanisms of Severe Acute Influenza Consortium, Impaired Antibody-mediated Protection and Defective IgA B-Cell Memory in Experimental Infection of Adults with Respiratory Syncytial Virus. *Am J Respir Crit Care Med* 191, 1040-1049 (2015).

29. T. Tiller, E. Meffre, S. Yurasov, M. Tsuiji, M. C. Nussenzweig, H. Wardemann, Efficient generation of monoclonal antibodies from single human B cells by single cell RT-PCR and expression vector cloning. *J Immunol Methods* 329, 112-124 (2008).

30. Z. A. Bornholdt, H. L. Turner, C. D. Murin, W. Li, D. Sok, C. A. Souders, A. E. Piper, A. Goff, J. D. Shamblin, S. E. Wollen, T. R. Sprague, M. L. Fusco, K. B. Pommert, L. A. Cavacini, H. L. Smith, M. Klempner, K. A. Reimann, E. Krauland, T. U. Gerngross, K. D. Wittrup, E. O. Saphire, D. R. Burton, P. J. Glass, A. B. Ward, L. M. Walker, Isolation of potent neutralizing antibodies from a survivor of the 2014 Ebola virus outbreak. *Science* 351, 1078-1083 (2016).

31. J. F. Scheid, H. Mouquet, N. Feldhahn, M. S. Seaman, K. Velinzon, J. Pietzsch, R. G. Ott, R. M. Anthony, H. Zebroski, A. Hurley, A. Phogat, B. Chakrabarti, Y. Li, M. Connors, F. Pereyra, B. D. Walker, H. Wardemann, D. Ho, R. T. Wyatt, J. R. Mascola, J. V. Ravetch, M. C. Nussenzweig, Broad diversity of neutralizing antibodies isolated from memory B cells in HIV-infected individuals. *Nature* 458, 636-640 (2009).

32. J. Wrammert, K. Smith, J. Miller, W. A. Langley, K. Kokko, C. Larsen, N. Y. Zheng, I. Mays, L. Garman, C. Helms, J. James, G. M. Air, J. D. Capra, R. Ahmed, P. C. Wilson, Rapid cloning of high-affinity human monoclonal antibodies against influenza virus. *Nature* 453, 667-671 (2008).

33. S. D. Boyd, B. A. Gaeta, K. J. Jackson, A. Z. Fire, E. L. Marshall, J. D. Merker, J. M. Maniar, L. N. Zhang, B. Sahaf, C. D. Jones, B. B. Simen, B. Hanczaruk, K. D. Nguyen, K. C. Nadeau, M. Egholm, D. B. Miklos, J. L. Zehnder, A. M. Collins, Individual variation in the germline Ig gene repertoire inferred from variable region gene rearrangements. *J Immunol* 184, 6986-6992 (2010).

34. J. Sui, W. C. Hwang, S. Perez, G. Wei, D. Aird, L. M. Chen, E. Santelli, B. Stec, G. Cadwell, M. Ali, H. Wan, A. Murakami, A. Yammanuru, T. Han, N. J. Cox, L. A. Bankston, R. O. Donis, R. C. Liddington, W. A. Marasco, Structural and functional bases for broad-spectrum neutralization of avian and human influenza A viruses. *Nat Struct Mol Biol* 16, 265-273 (2009).

35. C. C. Huang, M. Venturi, S. Majeed, M. J. Moore, S. Phogat, M. Y. Zhang, D. S. Dimitrov, W. A. Hendrickson, J. Robinson, J. Sodroski, R. Wyatt, H. Choe, M. Farzan, P. D. Kwong, Structural basis of tyrosine sulfation and VH-gene usage in antibodies that recognize the HIV type 1 coreceptor-binding site on gp120. *Proc Natl Acad Sci USA* 101, 2706-2711 (2004).

36. C. H. Chan, K. G. Hadlock, S. K. Foung, S. Levy, V(H)1-69 gene is preferentially used by hepatitis C virus-associated B cell lymphomas and by normal B cells responding to the E2 viral antigen. *Blood* 97, 1023-1026 (2001).

37. E. E. Godoy-Lozano, J. Tellez-Sosa, G. Sanchez-Gonzalez, H. Samano-Sanchez, A. Aguilar-Salgado, A. Salinas-Rodriguez, E. Cortina-Ceballos, H. Vivanco-Cid, K. Hernandez-Flores, J. M. Pfaff, K. M. Kahle, B. J. Doranz, R. E. Gomez-Barreto, H. Valdovinos-Torres, I. Lopez-Martinez, M. H. Rodriguez, J. Martinez-Barnetche, Lower IgG somatic hypermutation rates during acute dengue virus infection is compatible with a germinal center-independent B cell response. *Genome Med* 8, 23 (2016).

38. J. Wrammert, D. Koutsonanos, G. M. Li, S. Edupuganti, J. Sui, M. Morrissey, M. McCausland, I. Skountzou, M. Hornig, W. I. Lipkin, A. Mehta, B. Razavi, C. Del Rio, N. Y. Zheng, J. H. Lee, M. Huang, Z. Ali, K. Kaur, S. Andrews, R. R. Amara, Y. Wang, S. R. Das, C. D. O'Donnell, J. W. Yewdell, K. Subbarao, W. A. Marasco, M. J. Mulligan, R. Compans, R. Ahmed, P. C. Wilson, Broadly cross-reactive antibodies dominate the human B cell response against 2009 pandemic H1N1 influenza virus infection. *J Exp Med* 208, 181-193 (2011).

39. S. F. Andrews, Y. Huang, K. Kaur, L. I. Popova, I. Y. Ho, N. T. Pauli, C. J. Henry Dunand, W. M. Taylor, S. Lim, M. Huang, X. Qu, J. H. Lee, M. Salgado-Ferrer, F. Krammer, P. Palese, J. Wrammert, R. Ahmed, P. C. Wilson, Immune history profoundly affects broadly protective B cell responses to influenza. *Sci Transl Med* 7, 316ra192 (2015).

40. M. Liu, G. Yang, K. Wiehe, N. I. Nicely, N. A. Vandergrift, W. Rountree, M. Bonsignori, S. M. Alam, J. Gao, B. F. Haynes, G. Kelsoe, Polyreactivity and autoreactivity among HIV-1 antibodies. *J Virol* 89, 784-798 (2015).

41. H. Mouquet, J. F. Scheid, M. J. Zoller, M. Krogsgaard, R. G. Ott, S. Shukair, M. N. Artyomov, J. Pietzsch, M. Connors, F. Pereyra, B. D. Walker, D. D. Ho, P. C. Wilson, M. S. Seaman, H. N. Eisen, A. K. Chakraborty, T. J. Hope, J. V. Ravetch, H. Wardemann, M. C. Nussenzweig, Polyreactivity increases the apparent affinity of anti-HIV antibodies by heteroligation. *Nature* 467, 591-595 (2010).

42. R. L. Kelly, T. Sun, T. Jain, I. Caffry, Y. Yu, Y. Cao, H. Lynaugh, M. Brown, M. Vasquez, K. D. Wittrup, Y. Xu, High throughput cross-interaction measures for human IgG1 antibodies correlate with clearance rates in mice. *MAbs*, 0 (2015).

43. Y. Xu, W. Roach, T. Sun, T. Jain, B. Prinz, T. Y. Yu, J. Torrey, J. Thomas, P. Bobrowicz, M. Vasquez, K. D. Wittrup, E. Krauland, Addressing polyspecificity of antibodies selected from an in vitro yeast presentation system: a FACS-based, high-throughput selection and analytical tool. *Protein Eng Des Sel* 26, 663-670 (2013).

44. D. R. Bowley, A. F. Labrijn, M. B. Zwick, D. R. Burton, Antigen selection from an HIV-1 immune antibody library displayed on yeast yields many novel antibodies compared to selection from the same library displayed on phage. *Protein Eng Des Sel* 20, 81-90 (2007).

45. H. Wu, D. S. Pfarr, S. Johnson, Y. A. Brewah, R. M. Woods, N. K. Patel, W. I. White, J. F. Young, P. A. Kiener, Development of motavizumab, an ultra-potent antibody for the prevention of respiratory syncytial virus infection in the upper and lower respiratory tract. *Journal of molecular biology* 368, 652-665 (2007).

46. J. S. McLellan, M. Chen, J. S. Chang, Y. Yang, A. Kim, B. S. Graham, P. D. Kwong, Structure of a major antigenic site on the respiratory syncytial virus fusion glycoprotein in complex with neutralizing antibody 101F. *J Virol* 84, 12236-12244 (2010).

47. P. W. Parren, D. R. Burton, The antiviral activity of antibodies in vitro and in vivo. *Advances in immunology* 77, 195-262 (2001).

48. J. Foote, H. N. Eisen, Kinetic and affinity limits on antibodies produced during immune responses. *Proc Natl Acad Sci USA* 92, 1254-1256 (1995).

49. F. D. Batista, M. S. Neuberger, Affinity dependence of the B cell response to antigen: a threshold, a ceiling, and the importance of off-rate. *Immunity* 8, 751-759 (1998).

50. J. E. Schuster, R. G. Cox, A. K. Hastings, K. L. Boyd, J. Wadia, Z. Chen, D. R. Burton, R. A. Williamson, J. V. Williams, A broadly neutralizing human monoclonal antibody exhibits in vivo efficacy against both human metapneumovirus and respiratory syncytial virus. *J Infect Dis* 211, 216-225 (2015).

51. B. F. Fernie, P. J. Cote, Jr., J. L. Gerin, Classification of hybridomas to respiratory syncytial virus glycoproteins. Proceedings of the Society for Experimental Biology and Medicine. Society for Experimental Biology and Medicine (New York, N.Y.) 171, 266-271 (1982).

52. P. J. Cote, Jr., B. F. Fernie, E. C. Ford, J. W. Shih, J. L. Gerin, Monoclonal antibodies to respiratory syncytial virus: detection of virus neutralization and other antigen-antibody systems using infected human and murine cells. *Journal of virological methods* 3, 137-147 (1981).

53. E. E. Walsh, J. Hruska, Monoclonal antibodies to respiratory syncytial virus proteins: identification of the fusion protein. *J Virol* 47, 171-177 (1983).

54. L. J. Anderson, P. Bingham, J. C. Hierholzer, Neutralization of respiratory syncytial virus by individual and mixtures of F and G protein monoclonal antibodies. *J Virol* 62, 4232-4238 (1988).

55. G. E. Scopes, P. J. Watt, P. R. Lambden, Identification of a linear epitope on the fusion glycoprotein of respiratory syncytial virus. *J Gen Virol* 71 (Pt 1), 53-59 (1990).

56. J. Arbiza, G. Taylor, J. A. Lopez, J. Furze, S. Wyld, P. Whyte, E. J. Stott, G. Wertz, W. Sullender, M. Trudel, et al., Characterization of two antigenic sites recognized by neutralizing monoclonal antibodies directed against the fusion glycoprotein of human respiratory syncytial virus. *J Gen Virol* 73 (Pt 9), 2225-2234 (1992).

57. J. A. Lopez, R. Bustos, C. Orvell, M. Berois, J. Arbiza, B. Garcia-Barreno, J. A. Melero, Antigenic structure of human respiratory syncytial virus fusion glycoprotein. *J Virol* 72, 6922-6928 (1998).

58. B. J. DeKosky, T. Kojima, A. Rodin, W. Charab, G. C. Ippolito, A. D. Ellington, G. Georgiou, In-depth determination and analysis of the human paired heavy- and light-chain antibody repertoire. *Nat Med* 21, 86-91 (2015).

59. U.S. National Library of Medicine, (NCT02290340, https://clinicaltrials.gov/).

60. PATH, RSV Vaccine Snapshot (2016 http://sites.path.org/vaccinedevelopment/files/2016/07/RSV-snapshot-July_13_2016.pdf).

61. B. S. Graham, M. D. Perkins, P. F. Wright, D. T. Karzon, Primary respiratory syncytial virus infection in mice. *Journal of medical virology* 26, 153-162 (1988).

62. A. L. Hotard, F. Y. Shaikh, S. Lee, D. Yan, M. N. Teng, R. K. Plemper, J. E. Crowe, Jr., M. L. Moore, A stabilized respiratory syncytial virus reverse genetics system amenable to recombination-mediated mutagenesis. *Virology* 434, 129-136 (2012).

An informal sequence listing is provided in Table 6, below. The informal sequence listing for antibodies 124-231 provides the following sixteen (16) sequence elements contained in each of the 108 antibodies, identified as described above and designated as Antibody Numbers (Ab #) 124 through 231, in the following order:

Heavy chain variable region ("HC") nucleic acid sequence
Heavy chain variable region ("HC") amino acid sequence
Heavy chain variable region CDR H1 ("H1") amino acid sequence
Heavy chain variable region CDR H1 ("H1") nucleic acid sequence
Heavy chain variable region CDR H2 ("H2") amino acid sequence
Heavy chain variable region CDR H2 ("H2") nucleic acid sequence
Heavy chain variable region CDR H3 ("H3") amino acid sequence
Heavy chain variable region CDR H3 ("H3") nucleic acid sequence
Light chain variable region("LC") nucleic acid sequence
Light chain variable region ("LC") amino acid sequence
Light chain variable region CDR L1 ("L1") amino acid sequence
Light chain variable region CDR L1 ("L1") nucleic acid sequence
Light chain variable region CDR L2 ("L2") amino acid sequence
Light chain variable region CDR L2 ("L2") nucleic acid sequence
Light chain variable region CDR L3 ("L3") amino acid sequence
Light chain variable region CDR L3 ("L3") nucleic acid sequence The informal sequence listing for antibodies 232-244 provides the following ten (10) sequence elements contained in each of the 13 antibodies, identified as described above and designated as Antibody Numbers (Ab #) 232 through 244, in the following order:

Heavy chain variable region ("HC") nucleic acid sequence
Heavy chain variable region ("HC") amino acid sequence
Heavy chain variable region CDR H1 ("H1") amino acid sequence
Heavy chain variable region CDR H2 ("H2") amino acid sequence
Heavy chain variable region CDR H3 ("H3") amino acid sequence
Light chain variable region("LC") nucleic acid sequence
Light chain variable region ("LC") amino acid sequence
Light chain variable region CDR L1 ("L1") amino acid sequence
Light chain variable region CDR L2 ("L2") amino acid sequence
Light chain variable region CDR L3 ("L3") amino acid sequence

TABLE 6

Informal Sequence Listing

| Antibody No. | Seq. Ref. No. | SEQ ID NO. | Sequence |
|---|---|---|---|
| 124 | 1969 | 1 | CAGGTGCAGCTGGTGGAGTCTGGTCCTGCGCTGGTGAAACCCACACAGA CCCTCACACTGACCTGCAGCTTCTCCGGGTTCTCACTCACCACTAGGAGA ATGTGTGTGAGCTGGATCCGTCAGACCCCAGGGAAGGCCCTGGAGTGGC TTGCACGCATTGATTGGGATGATGATAAAGACTACAGCACATCTCTGAA |

TABLE 6-continued

Informal Sequence Listing

| Antibody No. | Seq. Ref. No. | SEQ ID NO. | Sequence |
|---|---|---|---|
| | | | GACCAGGCTCACCATCTCCAAGGACACCTCCAAAAACCAGGTGGTCCTT<br>ACAATGACCAACATGGACCCTGTGGACACGGCCACGTATTACTGTGCAC<br>GGACCCACATTTATGATAGTAGTGGTTATTATCTATACTACTTTGACTAC<br>TGGGGCCAGGGAACCCTGGTCACCGTCTCTTCA |
| 124 | 1970 | 2 | QVQLVESGPALVKPTQTLTLTCSFSGFSLTTRRMCVSWIRQTPGKALEWLA<br>RIDWDDDKDYSTSLKTRLTISKDTSKNQVVLTMTNMDPVDTATYYCARTHI<br>YDSSGYYLYYFDYWGQGTLVTVSS |
| 124 | 1971 | 3 | FSLTTRRMCVS |
| 124 | 1972 | 4 | TTCTCACTCACCACTAGGAGAATGTGTGTGAGC |
| 124 | 1973 | 5 | RIDWDDDKDYSTSLKT |
| 124 | 1974 | 6 | CGCATTGATTGGGATGATGATAAAGACTACAGCACATCTCTGAAGACC |
| 124 | 1975 | 7 | ARTHIYDSSGYYLYYFDY |
| 124 | 1976 | 8 | GCACGGACCCACATTTATGATAGTAGTGGTTATTATCTATACTACTTTGA<br>CTAC |
| 124 | 1977 | 9 | GATATTGTGCTGACCCAGTCTCCATCCTCCCTGTCTGCATCTATAGGAGA<br>CAGAGTCACCATCACTTGCCGGGCAAGTCAGACCATTGCCAGCTATTTA<br>AATTGGTATCAGCAGAAACCAGGGAAAGCCCCTGAACTCCTGATCTATG<br>CTGCAACCAATTTGCAGAGTGGGGTCCCATCAAGGTTCAGTGGCAGTGG<br>ATCTGGGACAGATTTCACTCTCACCATCAGCAGTCTGCGACCTGAAGATT<br>TTGCAAGTTACTACTGTCAACAGAGTTACAGTAGTCCCTGGACGTTCGGC<br>CAAGGGACCAAAGTGGATATCAAA |
| 124 | 1978 | 10 | DIVLTQSPSSLSASIGDRVTITCRASQTIASYLNWYQQKPGKAPELLIYAATN<br>LQSGVPSRFSGSGSGTDFTLTISSLRPEDFASYYCQQSYSSPWTFGQGTKVDI<br>K |
| 124 | 1979 | 11 | RASQTIASYLN |
| 124 | 1980 | 12 | CGGGCAAGTCAGACCATTGCCAGCTATTTAAAT |
| 124 | 1981 | 13 | AATNLQS |
| 124 | 1982 | 14 | GCTGCAACCAATTTGCAGAGT |
| 124 | 1983 | 15 | QQSYSSPWT |
| 124 | 1984 | 16 | CAACAGAGTTACAGTAGTCCCTGGACG |
| 125 | 1985 | 17 | GAGGTGCAGCTGGTGGAGTCTGGCCCAGGACTGGTGAAGCCTTCGGGGA<br>CCCTGTCCCTCACCTGCACTGTCTCTGGTGACTCCATGAGTGATTACTAC<br>TGGAGCTGGATCCGGCAGTCCCCAGGGAGGGGACTGGAGTGGCTTGGAT<br>ATATCTATTACGATGGGAGCACCAACTACAACCCCTCCCTCAAGGGTCG<br>AGGCACCATTTCAATAGACACGTCCAAGAGCCAGTTCTCCCTGACGCTG<br>AGCTCTGTGAAGGCTGCGGACACGGCCGTGTATTACTGTGCGAGAGGGA<br>AGTACTATGATAGAGGTGGTTATTACCTGTTCTACCTTGACTACTGGGGC<br>CAGGGAATACTGGTCACCGTCTCCTCA |
| 125 | 1986 | 18 | EVQLVESGPGLVKPSGTLSLTCTVSGDSMSDYYWSWIRQSPGRGLEWLGYI<br>YYDGSTNYNPSLKGRGTISIDTSKSQFSLTLSSVKAADTAVYYCARGKYYD<br>RGGYYLFYLDYWGQGILVTVSS |
| 125 | 1987 | 19 | DSMSDYYWS |
| 125 | 1988 | 20 | GACTCCATGAGTGATTACTACTGGAGC |
| 125 | 1989 | 21 | YIYYDGSTNYNPSLKG |
| 125 | 1990 | 22 | TATATCTATTACGATGGGAGCACCAACTACAACCCCTCCCTCAAGGGT |
| 125 | 1991 | 23 | ARGKYYDRGGYYLFYLDY |
| 125 | 1992 | 24 | GCGAGAGGGAAGTACTATGATAGAGGTGGTTATTACCTGTTCTACCTTG<br>ACTAC |
| 125 | 1993 | 25 | GACATCCGGTTGACCCAGTCTCCATCCTCCCTGTCTGCATCTGTGGGAGA<br>CAGAGTCACCATCACTTGCCGGGCAAGTCAGACCATTGCCAGCTATGTA |

TABLE 6-continued

Informal Sequence Listing

| Antibody No. | Seq. Ref. No. | SEQ ID NO. | Sequence |
|---|---|---|---|
| | | | AACTGGTATCAGCAGAAACCAGGGAAAGCCCCTAAACTCCTTATCTATG CTGCATCCAGTTTGCAAGATGGGGTTCCATCAAGGTTCAGTGGCAGTGG ATCTGGGACAGATTTCGCTCTCACCATCAGCAGTCTGCAACCTGAAGATT TTGCAATTTACTTTTGTCAACAGAGTTACAGTACCCCCATATTCACTTTC GGCCCTGGGACCAAGGTGGAAATCAAA |
| 125 | 1994 | 26 | DIRLTQSPSSLSASVGDRVTITCRASQTIASYVNWYQQKPGKAPKLLIYAASS LQDGVPSRFSGSGSGTDFALTISSLQPEDFAIYFCQQSYSTPIFTFGPGTKVEIK |
| 125 | 1995 | 27 | RASQTIASYVN |
| 125 | 1996 | 28 | CGGGCAAGTCAGACCATTGCCAGCTATGTAAAC |
| 125 | 1997 | 29 | AASSLQD |
| 125 | 1998 | 30 | GCTGCATCCAGTTTGCAAGAT |
| 125 | 1999 | 31 | QQSYSTPIFT |
| 125 | 2000 | 32 | CAACAGAGTTACAGTACCCCCATATTCACT |
| 126 | 2001 | 33 | GAGGTGCAGCTGGTGGAGTCTGGGGGCGCCTTGGTAAAGCCGGGGGGT CCCTTAGACTCTCCTGTGTAGGCACTGGACTCACTTTCACTACTGCCTAC ATGAGCTGGGCCCGCCAGGCTCCAGGGAAGGGGCTGGAGTGGGTTGGTC GTATTAAGAGCAAAAGTGATGGTGGACAACAGACTACCCTACACCCGT CAAAGGCAGATTCACCATCTCAAGAGATGAATCCAAAAACACCCTGTAT CTGCAAATGAACAGCCTGAAAATCGAGGACACAGCCGTCTATTATTGTA CCACAGATAGGGGGATAACAGCTCGTCCTATCTTCGACTCCTGGGGCCA GGGAACCCTGGTCACCGTCTCCTCA |
| 126 | 2002 | 34 | EVQLVESGGALVKPGGSLRLSCVGTGLTFTTAYMSWARQAPGKGLEWVGR IKSKSDGGTTDYPTPVKGRFTISRDESKNTLYLQMNSLKIEDTAVYYCTTDR GITARPIFDSWGQGTLVTVSS |
| 126 | 2003 | 35 | LTFTTAYMS |
| 126 | 2004 | 36 | CTCACTTTCACTACTGCCTACATGAGC |
| 126 | 2005 | 37 | RIKSKSDGGTTDYPTPVKG |
| 126 | 2006 | 38 | CGTATTAAGAGCAAAAGTGATGGTGGACAACAGACTACCCTACACCCG TCAAAGGC |
| 126 | 2007 | 39 | TTDRGITARPIFDS |
| 126 | 2008 | 40 | ACCACAGATAGGGGGATAACAGCTCGTCCTATCTTCGACTCC |
| 126 | 2009 | 41 | CAGTCTGTCTTGACGCAGCCGCCCTCAGTGTCTGGGGCCCTAGGGCGGA GGGTCACCATCTCCTGCACTGGGAGCAGCTCCAACATCGGGGCGGGTTA TGATGTACATTGGTACAGGCAACTTCCAGGAACAGCCCCCAAACTCCTC ATTTATGGTAACACCAAACGGCCCTCAGGGGTCCCTGACCGATTCTCTGG CTCCAAGTATGCCACCTCAGCCTCCCTGGCCATCACTGGGCTCCAGGCTG AGGATGACGCTGATTATTACTGCCAGTCCTATGACGGCGGCCTGAGTGG TTATGTCTTCGGAACTGGGACCAAGCTCACCGTCCTA |
| 126 | 2010 | 42 | QSVLTQPPSVSGALGRRVTISCTGSSSNIGAGYDVHWYRQLPGTAPKLLIYG NTKRPSGVPDRFSGSKYATSASLAITGLQAEDDADYYCQSYDGGLSGYVFG TGTKLTVL |
| 126 | 2011 | 43 | TGSSSNIGAGYDVH |
| 126 | 2012 | 44 | ACTGGGAGCAGCTCCAACATCGGGGCGGGTTATGATGTACAT |
| 126 | 2013 | 45 | GNTKRPS |
| 126 | 2014 | 46 | GGTAACACCAAACGGCCCTCA |
| 126 | 2015 | 47 | QSYDGGLSGYV |
| 126 | 2016 | 48 | CAGTCCTATGACGGCGGCCTGAGTGGTTATGTC |
| 127 | 2017 | 49 | CAGGTCCAGCTTGTACAGTCTGGGGCTGAGGTGAAGAAGCCTGGGTCCT CGGTGAAGGTCTCCTGCAAGGCTTCTGGAGGCAACGTCAACATCTATGG AATCAGTTGGGTGCGACAGGCCCCTGGACAAGGGCTTGAGTGGATGGGA |

TABLE 6-continued

Informal Sequence Listing

| Antibody No. | Seq. Ref. No. | SEQ ID NO. | Sequence |
|---|---|---|---|
| | | | GGGATCATCCCTATTTATGATACAACAAAGTACGCACAGAAATTCCAGG<br>ACAGAGTCACGATTACCGCGGACAAATCCACGAGTACAGCCTACATGGA<br>GTTGAGCAGCCTGAGATCTGAGGACACGGCCGTATATTTCTGTGCGAGA<br>GATCTTGATTACGATATTTTGACTGGTTATTCCGTAAACTACTACTACTA<br>CGGTATGGACGTCTGGGGCCAAGGGACCACGGTCACCGTCTCCTCA |
| 127 | 2018 | 50 | QVQLVQSGAEVKKPGSSVKVSCKASGGNVNIYGISWVRQAPGQGLEWMG<br>GIIPIYDTTKYAQKFQDRVTITADKSTSTAYMELSSLRSEDTAVYFCARDLD<br>YDILTGYSVNYYYYGMDVWGQGTTVTVSS |
| 127 | 2019 | 51 | GNVNIYGIS |
| 127 | 2020 | 52 | GGCAACGTCAACATCTATGGAATCAGT |
| 127 | 2021 | 53 | GIIPIYDTTKYAQKFQD |
| 127 | 2022 | 54 | GGGATCATCCCTATTTATGATACAACAAAGTACGCACAGAAATTCCAGG<br>AC |
| 127 | 2023 | 55 | ARDLDYDILTGYSVNYYYYGMDV |
| 127 | 2024 | 56 | GCGAGAGATCTTGATTACGATATTTTGACTGGTTATTCCGTAAACTACTA<br>CTACTACGGTATGGACGTC |
| 127 | 2025 | 57 | CAGTCTGTCCTGACGCAGCCGCCCTCAGTGTCTGGGGCCCAGGGCAGA<br>GGGTCACCATCTCCTGCACTGGGAGCAGCTCCAACATCGGGGCAGGTTA<br>TGATGTACACTGGTACCAGCAGCTTCCAGGAACAGCCCCCAAACTCCTC<br>ATCTATGGTAACATCAATCGGCCCTCAGGGGTCCCTGACCGATTCTCTGG<br>CTCCAAGTCTGGCACCTCAGCCTCCCTGGCCATCACTGGGCTCCAGGCTG<br>AGGATGAGGCTGATTATTACTGCCAGTCCTGTGACAGCAGCCTAAGTGG<br>TTGGGTGTTCGGCGGAGGGACCAAGCTGACCATCCTA |
| 127 | 2026 | 58 | QSVLTQPPSVSGAPGQRVTISCTGSSSNIGAGYDVHWYQQLPGTAPKLLIYG<br>NINRPSGVPDRFSGSKSGTSASLAITGLQAEDEADYYCQSCDSSLSGWVFGG<br>GTKLTIL |
| 127 | 2027 | 59 | TGSSSNIGAGYDVH |
| 127 | 2028 | 60 | ACTGGGAGCAGCTCCAACATCGGGGCAGGTTATGATGTACAC |
| 127 | 2029 | 61 | GNINRPS |
| 127 | 2030 | 62 | GGTAACATCAATCGGCCCTCA |
| 127 | 2031 | 63 | QSCDSSLSGWV |
| 127 | 2032 | 64 | CAGTCCTGTGACAGCAGCCTAAGTGGTTGGGTG |
| 128 | 2033 | 65 | CAGGTCCAGCTTGTACAGTCTGGGGCTGAAGTGAAGAGGCCTGGGTCCT<br>CGGTGAAGGTCTCCTGCAAGGCTTCTGGAGGCACCTTCAGCAGCTTTGCT<br>ATCAACTGGGTGCGACAGGCCCCTGGACAAGGGCTTGAGTGGATGGGAG<br>GGCTCATCCCTATCTTTGGTACACCAAACAACGCACAGAAGTTCCAGGG<br>CAGAGTCACGATTACCGCGGACGAATCCACGAGCACAGCCTACATGGAG<br>CTGAGCAGCCTGAGATCTGAGGACACGGCCGTCTATTACTGTGCCTCATT<br>ACGATATTTTGACTGGCAACCTGGGGGGTCCTACTGGTTCGACCCCTGGG<br>GCCAGGGAACCCTGGTCACCGTCTCCTCA |
| 128 | 2034 | 66 | QVQLVQSGAEVKRPGSSVKVSCKASGGTFSSFAINWVRQAPGQGLEWMGG<br>LIPIFGTPNNAQKFQGRVTITADESTSTAYMELSSLRSEDTAVYYCASLRYFD<br>WQPGGSYWFDPWGQGTLVTVSS |
| 128 | 2035 | 67 | GTFSSFAIN |
| 128 | 2036 | 68 | GGCACCTTCAGCAGCTTTGCTATCAAC |
| 128 | 2037 | 69 | GLIPIFGTPNNAQKFQG |
| 128 | 2038 | 70 | GGGCTCATCCCTATCTTTGGTACACCAAACAACGCACAGAAGTTCCAGG<br>GC |
| 128 | 2039 | 71 | ASLRYFDWQPGGSYWFDP |
| 128 | 2040 | 72 | GCCTCATTACGATATTTTGACTGGCAACCTGGGGGGTCCTACTGGTTCGA<br>CCCC |

TABLE 6-continued

Informal Sequence Listing

| Antibody No. | Seq. Ref. No. | SEQ ID NO. | Sequence |
|---|---|---|---|
| 128 | 2041 | 73 | CAGCCTGGGCTGACTCAGCCACCCTCAGTGTCAGTGGCCCCAGGAAAGA<br>CGGCCAGGATTGCCTGTGGGGGAGACAACATTGGAACTAAAGGAGTGC<br>ACTGGTACCAGCAGAAGCCAGGCCAGGCCCCTGTGCTGGTCATCTATTA<br>TGATAGCGACCGGCCCTCAGGGATCCCTGAGCGATTCTCTGGTTCCAACT<br>CTGGGAACACGGCCACCCTGACCATCAGCGGGGTCGAAGCCGGGGATG<br>AGGCCGACTACTACTGTCAGGTTTGGGATACTATTGATGATCATAAGGA<br>TGGACTATTCGGCGGAGGGACCAAGCTCACCGTCCTA |
| 128 | 2042 | 74 | QPGLTQPPSVSVAPGKTARIACGGDNIGTKGVHWYQQKPGQAPVLVIYYDS<br>DRPSGIPERFSGSNSGNTATLTISGVEAGDEADYYCQVWDTIDDHKDGLFGG<br>GTKLTVL |
| 128 | 2043 | 75 | GGDNIGTKGVH |
| 128 | 2044 | 76 | GGGGGAGACAACATTGGAACTAAAGGAGTGCAC |
| 128 | 2045 | 77 | YDSDRPS |
| 128 | 2046 | 78 | TATGATAGCGACCGGCCCTCA |
| 128 | 2047 | 79 | QVWDTIDDHKDGL |
| 128 | 2048 | 80 | CAGGTTTGGGATACTATTGATGATCATAAGGATGGACTA |
| 129 | 2049 | 81 | CAGGTCCAGCTTGTGCAGTCTGGAGGTGAGGTGAAGAAGCCTGGCGCCT<br>CAGTGAAGGTCTCCTGCAAGGCTTCTGGTTACACCTTTACCACCTATGGA<br>ATCAGCTGGGTGCGACAGGCCCCTGGACATGGGCTTGAGTGGCTGGGAT<br>GGATCAGCCCTAAGAATGGCAACACAAAGTATGCACAGAAGGTCCAGG<br>GCAGAGTCACCATGACCATAGACCCAACCACGAGTACAGCCTACATGGA<br>ACTGAGGAGCCTGAGATCAGACGACACGGCCATGTATTACTGTGCGAGA<br>GACTATATTGTAGCAATAGTGGCTGCTCTCCCCCACGGTATGGACGTCTG<br>GGGCCAAGGGACCCTGGTCACTGTCTCCTCA |
| 129 | 2050 | 82 | QVQLVQSGGEVKKPGASVKVSCKASGYTFTTYGISWVRQAPGHGLEWLG<br>WISPKNGNTKYAQKVQGRVTMTIDPTTSTAYMELRSLRSDDTAMYYCARD<br>YIVAIVAALPHGMDVWGQGTLVTVSS |
| 129 | 2051 | 83 | YTFTTYGIS |
| 129 | 2052 | 84 | TACACCTTTACCACCTATGGAATCAGC |
| 129 | 2053 | 85 | WISPKNGNTKYAQKVQG |
| 129 | 2054 | 86 | TGGATCAGCCCTAAGAATGGCAACACAAAGTATGCACAGAAGGTCCAG<br>GGC |
| 129 | 2055 | 87 | ARDYIVAIVAALPHGMDV |
| 129 | 2056 | 88 | GCGAGAGACTATATTGTAGCAATAGTGGCTGCTCTCCCCCACGGTATGG<br>ACGTC |
| 129 | 2057 | 89 | CAGTCTGTCTTGACGCAGCCGCCCTCCCTGTCCGTGTCCCCAGGACAGAC<br>AGCCAGCATCTCCTGCTCTGGGATCAGTTGGGGAATAAATATGTTTGTT<br>GGTATCAGCAGAAGCCAGGCCAGTCCCCTGTTCTGGTCATCTATCAAGA<br>TTCCAGGCGGCCCTCAGGGGTCCCTGAGCGATTCTCTGGCTCCAACTCCG<br>GGAACACAGCCACTCTGACCGTCGGCGGGACCCAGCCTATGGATGAGGC<br>TGACTATTACTGTCAGGCGTGGGACAGCAGCATTCGGGTATTCGGCGGA<br>GGGACCAAGGTGACCGTCCTA |
| 129 | 2058 | 90 | QSVLTQPPSLSVSPGQTASISCSGDQLGNKYVCWYQQKPGQSPVLVIYQDSR<br>RPSGVPERFSGSNSGNTATLTVGGTQPMDEADYYCQAWDSSIRVFGGGTKV<br>TVL |
| 129 | 2059 | 91 | SGDQLGNKYVC |
| 129 | 2060 | 92 | TCTGGGGATCAGTTGGGGAATAAATATGTTTGT |
| 129 | 2061 | 93 | QDSRRPS |
| 129 | 2062 | 94 | CAAGATTCCAGGCGGCCCTCA |
| 129 | 2063 | 95 | QAWDSSIRV |

TABLE 6-continued

Informal Sequence Listing

| Antibody No. | Seq. Ref. No. | SEQ ID NO. | Sequence |
|---|---|---|---|
| 129 | 2064 | 96 | CAGGCGTGGGACAGCAGCATTCGGGTA |
| 130 | 2065 | 97 | CAGGTCCAGCTTGTACAGTCTGGGGCTGAGGTGAAGAAGCCTGGGTCCT<br>CGGTGAAGGTCTCCTGCAAGGCCTCTGGAGGCTCCTTGAGCACCTATGG<br>GATCCACTGGGTGCGACAGGCCCCTGGCCAAGGCCTTGAGTGGGTGGGA<br>GGGGTCATGACTGTCTATGGCAAAACAACCTACGGACAGAACTTCCAGG<br>GCAGAGTCACCATTGCCGTGGACAGATCGACCAACACAGCCTACATGGA<br>ACTGAGCAGCCTAACATCTGACGACACGGGTACTTATTACTGTGCGACA<br>GACTCCTACTATGTTTGGACTGGTTCTTATCCCCCCCCCTTTGACCTCTGG<br>GGCCAGGGAACCCTGGTCACCGTCTCCTCA |
| 130 | 2066 | 98 | QVQLVQSGAEVKKPGSSVKVSCKASGGSLSTYGIHWVRQAPGQGLEWVGG<br>VMTVYGKTTYGQNFQGRVTIAVDRSTNTAYMELSSLTSDDTGTYYCATDS<br>YYVWTGSYPPPFDLWGQGTLVTVSS |
| 130 | 2067 | 99 | GSLSTYGIH |
| 130 | 2068 | 100 | GGCTCCTTGAGCACCTATGGGATCCAC |
| 130 | 2069 | 101 | GVMTVYGKTTYGQNFQG |
| 130 | 2070 | 102 | GGGGTCATGACTGTCTATGGCAAAACAACCTACGGACAGAACTTCCAGG<br>GC |
| 130 | 2071 | 103 | ATDSYYVWTGSYPPPFDL |
| 130 | 2072 | 104 | GCGACAGACTCCTACTATGTTTGGACTGGTTCTTATCCCCCCCCTTTGA<br>CCTC |
| 130 | 2073 | 105 | GAAATTGTGTTGACCCAGACTCCAGGCACCCAGTCTTTGTCTCCAGGGCA<br>AAGTGCCACCCTCTCCTGCAGGGCCAGTCACAGTGTCGGCAACGACTAC<br>TTGGCCTGGTATCAGCAGAAGCCTGGCCAGTCTCCCCGGCTCCTCATTCA<br>CGGTGCATACAGGAGGGACTCTGGCATCCCAGACAGGTTCATTGGCAGT<br>GGGTCTGGGACAGACTTCACTCTCACCATCGACAGTCTGGAGCCTGACG<br>ATTGTGCAGTATATTACTGTCAGCAGTATGGGAGCTGGCCTCTCACTTTC<br>GGCGGAGGGACCAAAGTGGATATCAAA |
| 130 | 2074 | 106 | EIVLTQTPGTQSLSPGQSATLSCRASHSVGNDYLAWYQQKPGQSPRLLIHGA<br>YRRDSGIPDRFIGSGSGTDFTLTIDSLEPDDCAVYYCQQYGSWPLTFGGGTK<br>VDIK |
| 130 | 2075 | 107 | RASHSVGNDYLA |
| 130 | 2076 | 108 | AGGGCCAGTCACAGTGTCGGCAACGACTACTTGGCC |
| 130 | 2077 | 109 | GAYRRDS |
| 130 | 2078 | 110 | GGTGCATACAGGAGGGACTCT |
| 130 | 2079 | 111 | QQYGSWPLT |
| 130 | 2080 | 112 | CAGCAGTATGGGAGCTGGCCTCTCACT |
| 131 | 2081 | 113 | GAGGTGCAGCTGGTGGAGTCTGGGGGAGGCGTGGTCCAGCCTGGGAGGT<br>CCCTGAGACTCTCCTGTGTTACCTCTGGATTCATCTTCAGCAATTATGCT<br>ATGCACTGGGTCCGCCAGGCTCAGGCAAGGGGCTGGAGTGGGTGGCAG<br>TTATATCCTTTGATGCAGACAATGAATATTATGCAGAGTCCGTGAAGGG<br>CCGATTCACCATCTCCAGAGACAATTCCAAGAACACGATGTATCTGCAA<br>ATGAACAGCCTGAGAGCCGGGACACAGCTCTCTATTACTGTGCGAGAG<br>ATCCTCTGGGTATAGGAGTGAAGGGCTACGTTGACTTCTGGGGCCAGGG<br>AACCCTGGTCACCGTCTCCTCA |
| 131 | 2082 | 114 | EVQLVESGGGVVQPGRSLRLSCVTSGFIFSNYAMHWVRQAPGKGLEWVAV<br>ISFDADNEYYAESVKGRFTISRDNSKNTMYLQMNSLRAGDTALYYCARDPL<br>GIGVKGYVDFWGQGTLVTVSS |
| 131 | 2083 | 115 | FIFSNYAMH |
| 131 | 2084 | 116 | TTCATCTTCAGCAATTATGCTATGCAC |
| 131 | 2085 | 117 | VISFDADNEYYAESVKG |
| 131 | 2086 | 118 | GTTATATCCTTTGATGCAGACAATGAATATTATGCAGAGTCCGTGAAGG<br>GC |

TABLE 6-continued

Informal Sequence Listing

| Antibody No. | Seq. Ref. No. | SEQ ID NO. | Sequence |
|---|---|---|---|
| 131 | 2087 | 119 | ARDPLGIGVKGYVDF |
| 131 | 2088 | 120 | GCGAGAGATCCTCTGGGTATAGGAGTGAAGGGCTACGTTGACTTC |
| 131 | 2089 | 121 | TCCTCTGAGCTGAGTCAGCCACCCTCAGTGTCAGTGGCCCCAGGAGAGA<br>CGGCCAGGATTACTTGTGGGGGAGACAACTTTGGAAGTGACGGTCTGCA<br>CTGGTACCAGCAGAAGCCAGGCCAGGCCCCTGTGTTGGTCATCTATTAT<br>GATAGCGACCGGCCCTCAGGGATCCCTGAGCGATTCTCCGGCTCCATCTC<br>TGGGAACACGGCCACCTTGACCATCAGCAGGGTCGAAGCCGGGGATGA<br>GGCCGACTATTTCTGTCAGGTGTGGGATAGTATTAGTGATCATCTGGTAT<br>TCGGCGGGGGGACCAAGGTGACCGTCCTA |
| 131 | 2090 | 122 | SSELSQPPSVSVAPGETARITCGGDNFGSDGLHWYQQKPGQAPVLVIYYDSD<br>RPSGIPERFSGSISGNTATLTISRVEAGDEADYFCQVWDSISDHLVFGGGTKV<br>TVL |
| 131 | 2091 | 123 | GGDNFGSDGLH |
| 131 | 2092 | 124 | GGGGGAGACAACTTTGGAAGTGACGGTCTGCAC |
| 131 | 2093 | 125 | YDSDRPS |
| 131 | 2094 | 126 | TATGATAGCGACCGGCCCTCA |
| 131 | 2095 | 127 | QVWDSISDHLV |
| 131 | 2096 | 128 | CAGGTGTGGGATAGTATTAGTGATCATCTGGTA |
| 132 | 2097 | 129 | CAGGTCCAGCTTGTGCAGTCTGGGGCTGAGGTGAAGAAGCCTGGGTCCT<br>CGGTGAAGGTCTCCTGCAAGGCTTCTGGAGGCACCTTCAGCAGTTATGCT<br>ATCAACTGGGTGCGACAGGCCCCTGGACAAGGGCTTGAGTGGATGGGAG<br>GGATCATCCCTGCCTTTGGTACAACAATCTACGCACAGAGGTTCCAGGA<br>CAGAGTCACGATTACCGCGGACAAATCCACGAGCACAGCCTACATGGAG<br>CTGAGGAGCCTGAGATCTGAGGACACGGCCGTGTATTACTGTGCGAGGT<br>CACCACCCTTTTGGAGTGACTATAGCCGTGGGTGGTTCGACCCCTGGGGC<br>CAGGGAACCCTGGTCACCGTCTCCTCA |
| 132 | 2098 | 130 | QVQLVQSGAEVKKPGSSVKVSCKASGGTFSSYAINWVRQAPGQGLEWMG<br>GIIPAFGTTIYAQRFQDRVTITADKSTSTAYMELRSLRSEDTAVYYCARSPPF<br>WSDYSRGWFDPWGQGTLVTVSS |
| 132 | 2099 | 131 | GTFSSYAIN |
| 132 | 2100 | 132 | GGCACCTTCAGCAGTTATGCTATCAAC |
| 132 | 2101 | 133 | GIIPAFGTTIYAQRFQD |
| 132 | 2102 | 134 | GGGATCATCCCTGCCTTTGGTACAACAATCTACGCACAGAGGTTCCAGG<br>AC |
| 132 | 2103 | 135 | ARSPPFWSDYSRGWFDP |
| 132 | 2104 | 136 | GCGAGGTCACCACCCTTTTGGAGTGACTATAGCCGTGGGTGGTTCGACC<br>CC |
| 132 | 2105 | 137 | GAAACGACACTCACGCAGTCTCCATCCGCCCTGTCTGCATCTGTAGGAG<br>ACAGAGTCACCATCACTTGCCGGGCAAGTCAGACCATTAGCGGCTATTT<br>AAATTGGTATCAGCAGAAACCAGGGAAAGCCCCTAAGCTCCTGATCTAT<br>GCTGCATCCAGTTTGCAAAGTGGGGTCCCGTCGAGATTCAGTGGCAGTA<br>GCGCTGGGACAGATTTCACTCTCTCCATCAGCAATCTACAACCTGAAGAT<br>TTTGCAACTTACTACTGTCAACAGAGTTACACTACCCCGTGGACGTTCGG<br>CCAAGGGACCAAGGTGGAAATCAAA |
| 132 | 2106 | 138 | ETTLTQSPSALSASVGDRVTITCRASQTISGYLNWYQQKPGKAPKLLIYAAS<br>SLQSGVPSRFSGSSAGTDFTLSISNLQPEDFATYYCQQSYTTPWTFGQGTKV<br>EIK |
| 132 | 2107 | 139 | RASQTISGYLN |
| 132 | 2108 | 140 | CGGGCAAGTCAGACCATTAGCGGCTATTTAAAT |
| 132 | 2109 | 141 | AASSLQS |

TABLE 6-continued

Informal Sequence Listing

| Antibody No. | Seq. Ref. No. | SEQ ID NO. | Sequence |
|---|---|---|---|
| 132 | 2110 | 142 | GCTGCATCCAGTTTGCAAAGT |
| 132 | 2111 | 143 | QQSYTTPWT |
| 132 | 2112 | 144 | CAACAGAGTTACACTACCCCGTGGACG |
| 133 | 2113 | 145 | CAGGTCCAGCTGGTGCAGTCTGGAGCAGAGGTGAAAAAGCCCGGAGAC<br>TCTCTGAAGATCTCCTGTAAGAATGCTGGACACACCTCTAGAATCTACTG<br>GATCGCCTGGGTGCGCCAGATGCCCGCGAAAGGCCTGGAGTACATGGGC<br>ATCATCTTTCCTGGTGACTCTGATACCAGATACAGTCCGTCCTTCCGAGG<br>CCAGGTCACCATCTCAGCCGACAGGTCCATCAGAACTGCCTACCTGCAG<br>TTGAGCAGCCTGAAGGCCTCGGACACCGGCATTTATTACTGTGCGACAC<br>AGGGGCTTGAGGGGGCTTTTGACTACTGGGGCCAGGGAACCCTGGTCAC<br>CGTCTCCTCA |
| 133 | 2114 | 146 | QVQLVQSGAEVKKPGDSLKISCKNAGHTSRIYWIAWVRQMPAKGLEYMGII<br>FPGDSDTRYSPSFRGQVTISADRSIRTAYLQLSSLKASDTGIYYCATQGLEGA<br>FDYWGQGTLVTVSS |
| 133 | 2115 | 147 | HTSRIYWIA |
| 133 | 2116 | 148 | CACACCTCTAGAATCTACTGGATCGCC |
| 133 | 2117 | 149 | IIFPGDSDTRYSPSFRG |
| 133 | 2118 | 150 | ATCATCTTTCCTGGTGACTCTGATACCAGATACAGTCCGTCCTTCCGAGG<br>C |
| 133 | 2119 | 151 | ATQGLEGAFDY |
| 133 | 2120 | 152 | GCGACACAGGGGCTTGAGGGGCTTTTGACTAC |
| 133 | 2121 | 153 | GACATCCGGTTGACCCAGTCTCCATCCTCCCTGTCTGCATCTGTAGGAGA<br>CAGAGTCACCATCACTTGCCAGGCGAGTCAGGACATTAGCAACCAGTTA<br>AATTGGTATCAGCAGAAACCAGGGACAGCCCCTAAGCTCCTCATCTACG<br>ATGCATCCTTTTTGCAAACAGGGGTCCCATCAAGGTTCAGTGGAAGTGG<br>ATCTGGGACACATTTTACTTTCACCATCACCAGCCTGCAGCCTGAAGATT<br>TTGCAACATATTTCTGTCAGCATTATGATAGTTTCCCCATATTCACTTTCG<br>GCCCTGGGACCAAGCTGGAGATCAAA |
| 133 | 2122 | 154 | DIRLTQSPSSLSASVGDRVTITCQASQDISNQLNWYQQKPGTAPKLLIYDASF<br>LQTGVPSRFSGSGSGTHFTFTITSLQPEDFATYFCQHYDSFPIFTFGPGTKLEI<br>K |
| 133 | 2123 | 155 | QASQDISNQLN |
| 133 | 2124 | 156 | CAGGCGAGTCAGGACATTAGCAACCAGTTAAAT |
| 133 | 2125 | 157 | DASFLQT |
| 133 | 2126 | 158 | GATGCATCCTTTTTGCAAACA |
| 133 | 2127 | 159 | QHYDSFPIFT |
| 133 | 2128 | 160 | CAGCATTATGATAGTTTCCCCATATTCACT |
| 134 | 2129 | 161 | GAGGTGCAGCTGGTGGAGTCTGGGGGAGGCTTGGTACAGCCTGGCAGGT<br>CCCTGCGACTCTCCTGTGCAGCCTCTGGATTCACCTTTGATGATTATGCC<br>ATGCACTGGGTCCGGCAAGCTCCAGGGAAGGGCCTGGAGTGGGTCTCAG<br>GCATCAGTTGGAATAGTGGTATTGTAAAGTATGCGGACTCTGTGAAGGG<br>CCGATTCACCATCTCCAGAGACAACGCCAAGAACTCCCTGTATCTGCAA<br>ATGAACAGTCTGAGAACTGAGGACACGGCCTTGTATTATTGTGTAAAAG<br>ACGGTTATACCAGCAGTTGGCACTCGGACTACCACTACGGCTTGGACGT<br>CTGGGGCCAAGGGACCACGGTCACCGTCTCCTCA |
| 134 | 2130 | 162 | EVQLVESGGGLVQPGRSLRLSCAASGFTFDDYAMHWVRQAPGKGLEWVS<br>GISWNSGIVKYADSVKGRFTISRDNAKNSLYLQMNSLRTEDTALYYCVKDG<br>YTSSWHSDYHYGLDVWGQGTTVTVSS |
| 134 | 2131 | 163 | FTFDDYAMH |
| 134 | 2132 | 164 | TTCACCTTTGATGATTATGCCATGCAC |
| 134 | 2133 | 165 | GISWNSGIVKYADSVKG |

TABLE 6-continued

Informal Sequence Listing

| Antibody No. | Seq. Ref. No. | SEQ ID NO. | Sequence |
|---|---|---|---|
| 134 | 2134 | 166 | GGCATCAGTTGGAATAGTGGTATTGTAAAGTATGCGGACTCTGTGAAGGGC |
| 134 | 2135 | 167 | VKDGYTSSWHSDYHYGLDV |
| 134 | 2136 | 168 | GTAAAAGACGGTTATACCAGCAGTTGGCACTCGGACTACCACTACGGCTTGGACGTC |
| 134 | 2137 | 169 | GATATTGTGATGACTCAGTCTCCAGCCACCCTGTCTCTGTCTCCAGGGGACAGAGCCACCCTCTCCTGCAGGGCCAGTCAGAATGTTATCAGCAACTTGGCCTGGTACCAGCAGAAACCTGGCCAGGCTCCCAGGCTCCTCATCTATACTGTATCCACCAGGGCCACTGGTATCCCAGCCAGGTTCAGTGGCAGTGGGTCTGGGACAGACTTCACTCTCACCATCAGCAGCCTGCAGTCTGAAGATTTTGCAGTTTATTACTGTCAGCAGTATAATAACTGGCCTCTCACTTTCGGCGGAGGGACCAAGGTGGAAATCAAA |
| 134 | 2138 | 170 | DIVMTQSPATLSLSPGDRATLSCRASQNVISNLAWYQQKPGQAPRLLIYTVSTRATGIPARFSGSGSGTDFTLTISSLQSEDFAVYYCQQYNNWPLTFGGGTKVEIK |
| 134 | 2139 | 171 | RASQNVISNLA |
| 134 | 2140 | 172 | AGGGCCAGTCAGAATGTTATCAGCAACTTGGCC |
| 134 | 2141 | 173 | TVSTRAT |
| 134 | 2142 | 174 | ACTGTATCCACCAGGGCCACT |
| 134 | 2143 | 175 | QQYNNWPLT |
| 134 | 2144 | 176 | CAGCAGTATAATAACTGGCCTCTCACT |
| 135 | 2145 | 177 | CAGGTCCAGCTTGTGCAGTCTGGGGCTGAGGTGAAGAAGCCTGGGTCGTCGGTGAAGGTCTCCTGCAAGGCTTCTGGAGACACCTTCAACAGTTATTCCATCAGCTGGGTGCGACAGGCCCCTGGACAAGGGCTTGAGTGGATGGGAGGAATCCTCCCTATGTTTGGTTCGTCAGACTACGCACAGAAGTTCCAGGGCAGACTCACAATTACCGCGGACGAATCCACGAGGACAGCCTACATGGAGCTGAACAGTCTGACATCTGAGGACACGGCCATTTACTACTGTGCGAGAGACAATTACTATGTTTGGACTGGTCGTTATCCCGAATTTGACTTCTGGGGCCAGGGAACCCTGGTCACCGTCTCCTCA |
| 135 | 2146 | 178 | QVQLVQSGAEVKKPGSSVKVSCKASGDTFNSYSISWVRQAPGQGLEWMGGILPMFGSSDYAQKFQGRLTITADESTRTAYMELNSLTSEDTAIYYCARDNYYVWTGRYPEFDFWGQGTLVTVSS |
| 135 | 2147 | 179 | DTFNSYSIS |
| 135 | 2148 | 180 | GACACCTTCAACAGTTATTCCATCAGC |
| 135 | 2149 | 181 | GILPMFGSSDYAQKFQG |
| 135 | 2150 | 182 | GGAATCCTCCCTATGTTTGGTTCGTCAGACTACGCACAGAAGTTCCAGGGC |
| 135 | 2151 | 183 | ARDNYYVWTGRYPEFDF |
| 135 | 2152 | 184 | GCGAGAGACAATTACTATGTTTGGACTGGTCGTTATCCCGAATTTGACTTC |
| 135 | 2153 | 185 | GAAATTGTGTTGACACAGTCTCCAGGCACCCTGTCCTTGTCTCCAGGGGAAGAAGCCACCCTCTCCTGCAGGGCCAGTCAGAGTGTTACCAGCAATTACTTAGCCTGGTACCAGCAGAGGCCTGGCCAGGCTCCCAGGCTCCTCATCTCTGGTGCATCCAGAAGGGCCACTGCCGTCCCAGACAGGTTCAGTGGCAGTGGGTCTGGGACAGACTTCACTCTCACCATCAGCAGACTGGAGCCTGAAGATTTTGCAGTTTATTACTGTCAGCAATATGGAAGCACACCGATCACCTTCGGCCAGGGGACACGACTGGAGATTAAA |
| 135 | 2154 | 186 | EIVLTQSPGTLSLSPGEATLSCRASQSVTSNYLAWYQQRPGQAPRLLISGASRRATAVPDRFSGSGSGTDFTLTISRLEPEDFAVYYCQQYGSTPITFGQGTRLEIK |
| 135 | 2155 | 187 | RASQSVTSNYLA |

TABLE 6-continued

Informal Sequence Listing

| Antibody No. | Seq. Ref. No. | SEQ ID NO. | Sequence |
|---|---|---|---|
| 135 | 2156 | 188 | AGGGCCAGTCAGAGTGTTACCAGCAATTACTTAGCC |
| 135 | 2157 | 189 | GASRRAT |
| 135 | 2158 | 190 | GGTGCATCCAGAAGGGCCACT |
| 135 | 2159 | 191 | QQYGSTPIT |
| 135 | 2160 | 192 | CAGCAATATGGAAGCACACCGATCACC |
| 136 | 2161 | 193 | CAGGTCCAGCTGGTGCAGTCTGGAGCTGAGGTGAAGAAGCCTGGGGCCT CAGTGAAGGTCTCCTGCAAGGCTTCTGGATACACTTTCACCAATGATATA AACTGGGTGCGACAGGCCACTGGACAAGGGCTTGAGTGGATGGGGTGG ATGAACCCTAACAATGGTCACACAGGCTATGCACAGAGCTTCGAGGGCA GAGTCAGCATGACCAGGAACTCCGCCATAAACACAGCCTACCTGGAGCT GAGCAGCCTGAGATTTGACGATACGGCCATATATTATTGTGTATACAATT TCTGGAGTGATTCTTCAGTCTCCTGGGGCCAGGGAACCCTGGTCACCGTC TCCTCA |
| 136 | 2162 | 194 | QVQLVQSGAEVKKPGASVKVSCKASGYTFTNDINWVRQATGQGLEWMGW MNPNNGHTGYAQSFEGRVSMTRNSAINTAYLELSSLRFDDTAIYYCVYNFW SDSSVSWGQGTLVTVSS |
| 136 | 2163 | 195 | YTFTNDIN |
| 136 | 2164 | 196 | TACACTTTCACCAATGATATAAAC |
| 136 | 2165 | 197 | WMNPNNGHTGYAQSFEG |
| 136 | 2166 | 198 | TGGATGAACCCTAACAATGGTCACACAGGCTATGCACAGAGCTTCGAGG GC |
| 136 | 2167 | 199 | VYNFWSDSSVS |
| 136 | 2168 | 200 | GTATACAATTTCTGGAGTGATTCTTCAGTCTCC |
| 136 | 2169 | 201 | CAGTCTGTCGTGACGCAGCCGCCCTCAGTGTCTGGGGCCCCAGGGCAGA GTGTCGCCATCTCCTGCACTGGGAGCAGCTCCAACATCGGGCCAGGTTA TGATGTACACTGGTATCAGCAACTTCCGGGAGCAGCCCCCAAACTCCTC ATCTATGGTGACAGCAATCGGCCCTCAGGGGTCCCTGACCGATTCTCTAC CTCCAAGTCTGGCACCTCAGTTTCCCTGGCCATCACTGGGCTCCAGGCTG AGGATGAGGCTGATTATTACTGCCAGTCCTATGACAGCAGCCTCCGTGG TTATGTCTTCGGAACTGGGACCAAGCTCACCGTCCTA |
| 136 | 2170 | 202 | QSVVTQPPSVSGAPGQSVAISCTGSSSNIGPGYDVHWYQQLPGAAPKLLIYG DSNRPSGVPDRFSTSKSGTSVSLAITGLQAEDEADYYCQSYDSSLRGYVFGT GTKLTVL |
| 136 | 2171 | 203 | TGSSSNIGPGYDVH |
| 136 | 2172 | 204 | ACTGGGAGCAGCTCCAACATCGGGCCAGGTTATGATGTACAC |
| 136 | 2173 | 205 | GDSNRPS |
| 136 | 2174 | 206 | GGTGACAGCAATCGGCCCTCA |
| 136 | 2175 | 207 | QSYDSSLRGYV |
| 136 | 2176 | 208 | CAGTCCTATGACAGCAGCCTCCGTGGTTATGTC |
| 137 | 2177 | 209 | CAGGTCCAGCTTGTACAGTCTGGAGCTGAGGTGAAGAAGCCTGGGGCCT CAGTGAAGGTCTCCTGCAAGGCTTCTGGTTTCACCTTTACTAATTATGGT ATAAGTTGGGTGCGACAGGCCCCTGGACGAGGGCTTGAGTGGATGGGCT GGATCAGCGCTTACAATGGTAACACAGAGTATGCACAGAAGCTCCAAGA CAGACTCACCATGACCACAGACACATCTACGAACACAGCCTACATGGAG TTGAGGAGCCTGAGATCTGACGACACGGCCCTATATTATTGTGCGAGAG AGTCAGGTGTCGCAGCAGCTGCTACCTTACTTTACTGGGGCCAGGGAAC CCTGGTCACCGTCTCCTCA |
| 137 | 2178 | 210 | QVQLVQSGAEVKKPGASVKVSCKASGFTFTNYGISWVRQAPGRGLEWMG WISAYNGNTEYAQKLQDRLTMTTDTSTNTAYMELRSLRSDDTALYYCARE SGVAAAATLLYWGQGTLVTVSS |
| 137 | 2179 | 211 | FTFTNYGIS |

TABLE 6-continued

Informal Sequence Listing

| Antibody No. | Seq. Ref. No. | SEQ ID NO. | Sequence |
|---|---|---|---|
| 137 | 2180 | 212 | TTCACCTTTACTAATTATGGTATAAGT |
| 137 | 2181 | 213 | WISAYNGNTEYAQKLQD |
| 137 | 2182 | 214 | TGGATCAGCGCTTACAATGGTAACACAGAGTATGCACAGAAGCTCCAAG<br>AC |
| 137 | 2183 | 215 | ARESGVAAAATLLY |
| 137 | 2184 | 216 | GCGAGAGAGTCAGGTGTCGCAGCAGCTGCTACCTTACTTTAC |
| 137 | 2185 | 217 | GAAACGACACTCACGCAGTCTCCACTCTCCCTGCCCGTCACCCTTGGACA<br>ACCGGCCTCCATCTCCTGCAGGTCTAGTCAAAGCCTCGTATACAGCGATG<br>GAAACACCTACTTGAGTTGGTTTCAGCAGAGGCCAGGCCAATCTCCAAG<br>GCGCCTAATTTATAAGGTTTCTAACCGGGACTCTGGGGTCCCAGACAGA<br>TTCAGCGGCAGTGGGTCAGGCGCTGATTTCACACTGAAAATCAGCAGGG<br>TGGAGGCTGAGGATGTTGGGGTTTATTACTGCATGCAAGGTATATACTG<br>GCCTCGGACGTTCGGCCAAGGGACCAAAGTGGATATCAAA |
| 137 | 2186 | 218 | ETTLTQSPLSLPVTLGQPASISCRSSQSLVYSDGNTYLSWFQQRPGQSPRRLI<br>YKVSNRDSGVPDRFSGSGSGADFTLKISRVEAEDVGVYYCMQGIYWPRTFG<br>QGTKVDIK |
| 137 | 2187 | 219 | RSSQSLVYSDGNTYLS |
| 137 | 2188 | 220 | AGGTCTAGTCAAAGCCTCGTATACAGCGATGGAAACACCTACTTGAGT |
| 137 | 2189 | 221 | KVSNRDS |
| 137 | 2190 | 222 | AAGGTTTCTAACCGGGACTCT |
| 137 | 2191 | 223 | MQGIYWPRT |
| 137 | 2192 | 224 | ATGCAAGGTATATACTGGCCTCGGACG |
| 138 | 2193 | 225 | CAGGTGCAGCTGGTGGAGTCTGGGGCTGAGGTGCAGAAGCCTGGGGCCT<br>CAGTGAAGATTTCTTGCAAGGCATCTGGATACAAGTTCATCAGCTACTCC<br>ATACACTGGGTGCGACAGGCCCCTGGACAAGGACTTGAGTGGATGGGAG<br>TAATCAACCCTGGTGGCGGTCTCACAAACTATGCACAGAAGTTCCAGGA<br>CAGACTCACCATGACCAGGGACACGTCCACGGCCACAGTGACCATGGAA<br>CTGAGGAGCCTGAGATCTGACGACAGGGCCGTATATTTTTGTGGTAGAG<br>AAGACTCATATTGTAGTGGAGACAGCTGCTTCAATTCCGGTTCGGGGCG<br>CTGGGTCGACTCCTGGGGCCAGGGAACCCTGGTCACCGTCTCCTCA |
| 138 | 2194 | 226 | QVQLVESGAEVQKPGASVKISCKASGYKFISYSIHWVRQAPGQGLEWMGVI<br>NPGGGLTNYAQKFQDRLTMTRDTSTATVTMELRSLRSDDRAVYFCGREDS<br>YCSGDSCFNSGSGRWVDSWGQGTLVTVSS |
| 138 | 2195 | 227 | YKFISYSIH |
| 138 | 2196 | 228 | TACAAGTTCATCAGCTACTCCATACAC |
| 138 | 2197 | 229 | VINPGGGLTNYAQKFQD |
| 138 | 2198 | 230 | GTAATCAACCCTGGTGGCGGTCTCACAAACTATGCACAGAAGTTCCAGG<br>AC |
| 138 | 2199 | 231 | GREDSYCSGDSCFNSGSGRWVDS |
| 138 | 2200 | 232 | GGTAGAGAAGACTCATATTGTAGTGGAGACAGCTGCTTCAATTCCGGTT<br>CGGGGCGCTGGGTCGACTCC |
| 138 | 2201 | 233 | GACATCCAGGTGACCCAGTCTCCATCGTCCCTGTCTGCATCTGTCGGAGA<br>CAGAGTCACCATCACTTGCCGGGCAAGTCAGAGCGTTATCACCTATTTA<br>AATTGGTATCAGCAGAAACCAGGGAAAGCCCCTCAACTCCTGGTCTATG<br>CTGCTTCCATTTTGCAAAGTGGGGTCCCATCCAGCTTCAGTGGCAGTGGA<br>TCTGGGACAGATTTCACTCTCACCATCAGCAGTCTGCAACCTGAAGATTT<br>TGCAACTTACTACTGTCAACAGACTTACAGTACCCCTCATACTTTTGGCC<br>AGGGGACCAAAGTGGATATCAAA |
| 138 | 2202 | 234 | DIQVTQSPSSLSASVGDRVTITCRASQSVITYLNWYQQKPGKAPQLLVYAAS<br>ILQSGVPSSFSGSGSGTDFTLTISSLQPEDFATYYCQQTYSTPHTFGQGTKVDI<br>K |

TABLE 6-continued

Informal Sequence Listing

| Antibody No. | Seq. Ref. No. | SEQ ID NO. | Sequence |
|---|---|---|---|
| 138 | 2203 | 235 | RASQSVITYLN |
| 138 | 2204 | 236 | CGGGCAAGTCAGAGCGTTATCACCTATTTAAAT |
| 138 | 2205 | 237 | AASILQS |
| 138 | 2206 | 238 | GCTGCTTCCATTTTGCAAAGT |
| 138 | 2207 | 239 | QQTYSTPHT |
| 138 | 2208 | 240 | CAACAGACTTACAGTACCCCTCATACT |
| 139 | 2209 | 241 | GAGGTGCAGCTGGTGGAGTCTGGAGCTGAGGTGAAGAAGCCTGGGGCCT<br>CAGTGAAGGTCTCCTGCAAGGCTTCTGGTTACACCTTTGCCAACTATGGT<br>ATCACCTGGGTGCGACAGGCCCCTGGACAAGGGCTTGAGTACATGGGAT<br>GGATCAGCGCTTACAATGGTAACACAAACTATGCACAGAAGTTCCAGGG<br>CAGAGTCACCATGACCACGGACACATCCACGAGCACAGCGTACATGGAG<br>CTGAGGAGCCTGAGATCTGACGACACGGCCATTTATTACTGTGCGAGAG<br>ATCCCGGTGTTACGGCTGCTGTGCTACTTGACTACTGGGGCCAGGGAGC<br>CCTGGTCACCGTCTCCTCA |
| 139 | 2210 | 242 | EVQLVESGAEVKKPGASVKVSCKASGYTFANYGITWVRQAPGQGLEYMG<br>WISAYNGNTNYAQKFQGRVTMTTDTSTSTAYMELRSLRSDDTAIYYCARDP<br>GVTAAVLLDYWGQGALVTVSS |
| 139 | 2211 | 243 | YTFANYGIT |
| 139 | 2212 | 244 | TACACCTTTGCCAACTATGGTATCACC |
| 139 | 2213 | 245 | WISAYNGNTNYAQKFQG |
| 139 | 2214 | 246 | TGGATCAGCGCTTACAATGGTAACACAAACTATGCACAGAAGTTCCAGG<br>GC |
| 139 | 2215 | 247 | ARDPGVTAAVLLDY |
| 139 | 2216 | 248 | GCGAGAGATCCCGGTGTTACGGCTGCTGTGCTACTTGACTAC |
| 139 | 2217 | 249 | GATATTGTGTTGACCCAGTCTCCACTCTCCCTGCCCGTCACCCTTGGACA<br>GCCGGCCTCCATCTCCTGCAGGTCTAGTCAAAGCCTCGTATTCAGTGATG<br>GAAACACCTACTTGAGTTGGTTTCAGCAGAGGCCAGGCCAATCTCCAAG<br>GCGCCTACTTTATAAGGTTTCTAACCGGGACTCTGGGGTCCCAGACAGAT<br>TCAGCGGCAGTGGGTCAGGCACTGATTTCACACTGACAATCAGCAGGGT<br>GGAGGCTGAGGATGTTGGGGTTTATTACTGCTTGCAAGGTACACCCCCTT<br>ACACTTTTGGCCAGGGGACCAAAGTGGATATCAAA |
| 139 | 2218 | 250 | DIVLTQSPLSLPVTLGQPASISCRSSQSLVFSDGNTYLSWFQQRPGQSPRRLL<br>YKVSNRDSGVPDRFSGSGSGTDFTLTISRVEAEDVGVYYCLQGTPPYTFGQG<br>TKVDIK |
| 139 | 2219 | 251 | RSSQSLVFSDGNTYLS |
| 139 | 2220 | 252 | AGGTCTAGTCAAAGCCTCGTATTCAGTGATGGAAACACCTACTTGAGT |
| 139 | 2221 | 253 | KVSNRDS |
| 139 | 2222 | 254 | AAGGTTTCTAACCGGGACTCT |
| 139 | 2223 | 255 | LQGTPPYT |
| 139 | 2224 | 256 | TTGCAAGGTACACCCCCTTACACT |
| 140 | 2225 | 257 | CAGGTGCAGCTGGTGGAGTCTGGGGGAGGCGTGGTCCAGCCTGGGAAGT<br>CCCTGAGACTCTCCTGTGCAGCCTCTGGATTCACCTTCAGTAGCTATCCT<br>ATGCACTGGGTCCGCCAGGCTCCAGGCGCGGGGCTGGAGTGGATGGCCG<br>TAATCTCATATGATGGAGCCAATAAATACTATGAAGACTCCTTAAAGGG<br>CCGATTCACCATCTCCAGAGACAATTCCAAGGACACTCTGTTTCTGCAAA<br>TGAACAACCTGAGACCTGAGGACACGGCTGTCTATTACTGTGCGAGAGG<br>GAGGACTTCGCATATAAATACACCCGAGACTAAGTGGGGCCAGGGAACC<br>CTGGTCACCGTCTCCTCA |

TABLE 6-continued

Informal Sequence Listing

| Antibody No. | Seq. Ref. No. | SEQ ID NO. | Sequence |
|---|---|---|---|
| 140 | 2226 | 258 | QVQLVESGGGVVQPGKSLRLSCAASGFTFSSYPMHWVRQAPGAGLEWMA VISYDGANKYYEDSLKGRFTISRDNSKDTLFLQMNNLRPEDTAVYYCARGR TSHINTPETKWGQGTLVTVSS |
| 140 | 2227 | 259 | FTFSSYPMH |
| 140 | 2228 | 260 | TTCACCTTCAGTAGCTATCCTATGCAC |
| 140 | 2229 | 261 | VISYDGANKYYEDSLKG |
| 140 | 2230 | 262 | GTAATCTCATATGATGGAGCCAATAAATACTATGAAGACTCCTTAAAGG GC |
| 140 | 2231 | 263 | ARGRTSHINTPETK |
| 140 | 2232 | 264 | GCGAGAGGGAGGACTTCGCATATAAATACACCCGAGACTAAG |
| 140 | 2233 | 265 | GAAATTGTGTTGACGCAGTCTCCAACCTTAGTGTCTGCATCTACAGGAGA CACAGTCACCATCAGTTGCCGGATGAGTCAGGGCATTAACGGTTATTTA GCCTGGTTTCAGAAAAAACCAGGGAAAGCCCCTGACCTCCTGATCTATG GTGCATCCACTTTGCAAGATGGGGTCCCATCAAGGTTCAGTGGCAGTGG ATCTGGGACAGATTTCACTCTCACCATCAGTCGCCTGCAGTCTGAAGATT TGGCAACTTATTATTGTCAACAGTATTACAGTTTGCCGTGGACGTTCGGC CAAGGGACCAAAGTGGATATCAAA |
| 140 | 2234 | 266 | EIVLTQSPTLVSASTGDTVTISCRMSQGINGYLAWFQKKPGKAPDLLIYGAS TLQDGVPSRFSGSGSGTDFTLTISRLQSEDLATYYCQQYYSLPWTFGQGTKV DIK |
| 140 | 2235 | 267 | RMSQGINGYLA |
| 140 | 2236 | 268 | CGGATGAGTCAGGGCATTAACGGTTATTTAGCC |
| 140 | 2237 | 269 | GASTLQD |
| 140 | 2238 | 270 | GGTGCATCCACTTTGCAAGAT |
| 140 | 2239 | 271 | QQYYSLPWT |
| 140 | 2240 | 272 | CAACAGTATTACAGTTTGCCGTGGACG |
| 141 | 2241 | 273 | CAGGTCCAGCTTGTACAGTCTGGGGCTGAGGTGAAGAAGCCTGGGGCCT CAGTGAAGGTCTCCTGCAAGGCTTCTGGATACAGCTTCACCGACTACTAT ATACACTGGGTGCGACAGGCCCCTGGACAAGGGCTTGAGTGGATAGGAT GGATCAACCCTAACAGTGGTGGCACAACCTTTGCACAGAACTTTCAGGG CAGGGTCACCATGACCAGGGACACGTCCATCAGCACAGCCTTCCTGGAG CTGAGCAGGCTAAAATCTGACGACACGGCCGTATATTATTGTGCGAGAG ACGTTCTCTGGTTAAACGGATTCTGGGGCCTGGGAACCCTGGTCACCGTC TCTTCA |
| 141 | 2242 | 274 | QVQLVQSGAEVKKPGASVKVSCKASGYSFTDYYIHWVRQAPGQGLEWIG WINPNSGGTTFAQNFQGRVTMTRDTSISTAFLELSRLKSDDTAVYYCARDV LWLNGFWGLGTLVTVSS |
| 141 | 2243 | 275 | YSFTDYYIH |
| 141 | 2244 | 276 | TACAGCTTCACCGACTACTATATACAC |
| 141 | 2245 | 277 | WINPNSGGTTFAQNFQG |
| 141 | 2246 | 278 | TGGATCAACCCTAACAGTGGTGGCACAACCTTTGCACAGAACTTTCAGG GC |
| 141 | 2247 | 279 | ARDVLWLNGF |
| 141 | 2248 | 280 | GCGAGAGACGTTCTCTGGTTAAACGGATTC |
| 141 | 2249 | 281 | CAGTCTGTGGTGACGCAGCCGCCCTCAGTGTCTGCGGCCCCAGGACAGA AGGTCACCATCTCCTGCTCTGGAAGCAGCTCCAACATTGGGAATAATTAT GTATCCTGGTATCAGCAGTTCCGAGGAACAGCCCCCAAAGTCCTCATTTA |

TABLE 6-continued

Informal Sequence Listing

| Antibody No. | Seq. Ref. No. | SEQ ID NO. | Sequence |
|---|---|---|---|
| | | | TGAAAATAATAAGCGAACCTCAGGGATTCCTGACCGATTCTCTGGCTCC AAGTCTGGCACGTCAGCCACCCTGGGCATCACCGGACTCCAGACTGGGG ACGAGGCCGATTATTACTGCGGAACATGGGATAGCAGCCTGAGTACTGG CCCCTATGTGGTATTCGGCGGAGGGACCAAGCTGACCGTCCTA |
| 141 | 2250 | 282 | QSVVTQPPSVSAAPGQKVTISCSGSSSNIGNNYVSWYQQFRGTAPKVLIYEN NKRTSGIPDRFSGSKSGTSATLGITGLQTGDEADYYCGTWDSSLSTGPYVVF GGGTKLTVL |
| 141 | 2251 | 283 | SGSSSNIGNNYVS |
| 141 | 2252 | 284 | TCTGGAAGCAGCTCCAACATTGGGAATAATTATGTATCC |
| 141 | 2253 | 285 | ENNKRTS |
| 141 | 2254 | 286 | GAAAATAATAAGCGAACCTCA |
| 141 | 2255 | 287 | GTWDSSLSTGPYVV |
| 141 | 2256 | 288 | GGAACATGGGATAGCAGCCTGAGTACTGGCCCCTATGTGGTA |
| 142 | 2257 | 289 | CAGGTCCAGCTGGTGCAGTCTGGGGCTGAGGCAAGAAGCCTGGGGCCT CAGTGAAGGTTTCCTGTAAGGCATCTGGATATACCTTTACCAGCTACTAT TTGCACTGGGTGCGACAGGCCCCTGGACAAGGGCCTGAGTGGATGGGAA TAATCAACCCTGGTGGTGGTAGCACAGAGTTGTCACAGAAGTTCCAGGG CAGAGTCACCTTGACTAGGGACACGTCCACGAGCACAGTCTACATGGAG GTGACCAGCCTGACATCTGAGGACACGGCCGTCTATTACTGTGCGAGAG CCCGGATACAGCTCTGGGCACCAAATTACTACGGTATGGACGTCTGGGG CCAAGGGACCACGGTCACCGTCTCTTCA |
| 142 | 2258 | 290 | QVQLVQSGAEAKKPGASVKVSCKASGYTFTSYYLHWVRQAPGQGPEWMG IINPGGGSTELSQKFQGRVTLTRDTSTSTVYMEVTSLTSEDTAVYYCARARI QLWAPNYYGMDVWGQGTTVTVSS |
| 142 | 2259 | 291 | YTFTSYYLH |
| 142 | 2260 | 292 | TATACCTTTACCAGCTACTATTTGCAC |
| 142 | 2261 | 293 | IINPGGGSTELSQKFQG |
| 142 | 2262 | 294 | ATAATCAACCCTGGTGGTGGTAGCACAGAGTTGTCACAGAAGTTCCAGG GC |
| 142 | 2263 | 295 | ARARIQLWAPNYYGMDV |
| 142 | 2264 | 296 | GCGAGAGCCCGGATACAGCTCTGGGCACCAAATTACTACGGTATGGACG TC |
| 142 | 2265 | 297 | GACATCCAGTTGACCCAGTCTCCATCCTTCCTGTCTGCATCTGTAGGAGA CAGAGTCACCATCACTTGCCGGGCCAGTCATGGCATTACCAGTTATTTAG CCTGGTATCAGCAAAAACCAGGGAATGCCCCTAAGCTCCTGATCTATGC TGCATCCACTTTGCAAAGTGGGGTCCCATCAAGGTTCAGCGGCAGTGGG TCTGAGACACAGTTCACTCTCACAATCAGCGGCCTGCAGCCTGAAGATTT TGCAACTTATTACTGTCAACAGCTTAATCGTTACCCTCTAACGTTCGGCC AAGGGACCAAGGTGGAAATCAAA |
| 142 | 2266 | 298 | DIQLTQSPSFLSASVGDRVTITCRASHGITSYLAWYQQKPGNAPKLLIYAAST LQSGVPSRFSGSGSETQFTLTISGLQPEDFATYYCQQLNRYPLTFGQGTKVEI K |
| 142 | 2267 | 299 | RASHGITSYLA |
| 142 | 2268 | 300 | CGGGCCAGTCATGGCATTACCAGTTATTTAGCC |
| 142 | 2269 | 301 | AASTLQS |
| 142 | 2270 | 302 | GCTGCATCCACTTTGCAAAGT |
| 142 | 2271 | 303 | QQLNRYPLT |
| 142 | 2272 | 304 | CAACAGCTTAATCGTTACCCTCTAACG |
| 143 | 2273 | 305 | CAGGTCCAGCTTGTGCAGTCTGGAGCTGAGGTGAAGAAGCCTGGGGCCT CAGTGAAGATCTCCTGCAAGACCTCTGGTTACACCTTTACGAGCTCTGTG |

TABLE 6-continued

Informal Sequence Listing

| Antibody No. | Seq. Ref. No. | SEQ ID NO. | Sequence |
|---|---|---|---|
| | | | ATCAGCTGGGTGCGGCAGGCCCCTGGACAAGGGCTTGAGTGGGTGGGAT<br>GGATCACCGGTCACAGAAGTAGCACAAACTATGCACAGAGACTCCAGG<br>GTAGAGTCACCATGACCACAGACACATCCACGAGCACAGCCTATATGGA<br>GCTGAGGAGCCTGAGGTCTGACGACACGGCCGTGTATTACTGTGCGAGA<br>GCCGATGGTGGTTCGGGGAGTTATTATAGCGCCTGGGGCCAGGGAACCC<br>TGGTCACCGTCTCCTCA |
| 143 | 2274 | 306 | QVQLVQSGAEVKKPGASVKISCKTSGYTFTSSVISWVRQAPGQGLEWVGWI<br>TGHRSSTNYAQRLQGRVTMTTDTSTSTAYMELRSLRSDDTAVYYCARADG<br>GSGSYYSAWGQGTLVTVSS |
| 143 | 2275 | 307 | YTFTSSVIS |
| 143 | 2276 | 308 | TACACCTTTACGAGCTCTGTGATCAGC |
| 143 | 2277 | 309 | WITGHRSSTNYAQRLQG |
| 143 | 2278 | 310 | TGGATCACCGGTCACAGAAGTAGCACAAACTATGCACAGAGACTCCAGG<br>GT |
| 143 | 2279 | 311 | ARADGGSGSYYSA |
| 143 | 2280 | 312 | GCGAGAGCCGATGGTGGTTCGGGGAGTTATTATAGCGCC |
| 143 | 2281 | 313 | TCCTATGAGCTGACACAGCCACCCTCAGCGTCAGTGGCCCCAGGAAAGA<br>CGGCCAGGATCTCCTGTGGGGGAAACAACATTGGAACTAAGAGTGTCCA<br>CTGGTACCAGCAGAAGCCAGGCCAGGCCCCTGTCTTGGTCATCTATCAT<br>GATAGCCACCGGCCCTCAGGGATCCCTGAGCGATTCTCTGGCTCCAACTC<br>TGGGAACACGGCCACCCTGACCATCAGTAGGGTCGAAGCCGGGGATGA<br>GGCCGACTATTATTGTCAGCTGTGGGATAGTAGTAGTGATTCCCATGTCT<br>TCGGAACTGGGACCAAGCTCACCGTCCTA |
| 143 | 2282 | 314 | SYELTQPPSASVAPGKTARISCGGNNIGTKSVHWYQQKPGQAPVLVIYHDS<br>HRPSGIPERFSGSNSGNTATLTISRVEAGDEADYYCQLWDSSSDSHVFGTGT<br>KLTVL |
| 143 | 2283 | 315 | GGNNIGTKSVH |
| 143 | 2284 | 316 | GGGGGAAACAACATTGGAACTAAGAGTGTCCAC |
| 143 | 2285 | 317 | HDSHRPS |
| 143 | 2286 | 318 | CATGATAGCCACCGGCCCTCA |
| 143 | 2287 | 319 | QLWDSSSDSHV |
| 143 | 2288 | 320 | CAGCTGTGGGATAGTAGTAGTGATTCCCATGTC |
| 144 | 2289 | 321 | CAGGTGCAGCTGGTGCAGTCTGGGGGAGGCCTGGTCAAGCCTGGGGGGT<br>CCCTGAGACTCTCCTGTGCAGCCTCGGGATTCACCATCAGTGGTTATAAC<br>ATGTTCTGGGTCCGCCAGCCTCCGGGGAAGGGGCTGGAGTGGGTCTCAT<br>CCATTACTGCTGGTAGTAGTTATTTAAACTATGCAGACTCAGTGAAGGGC<br>CGTTTCATCGTCTCCAGAGACAACGCCAAGAATTCACTGTATCTGCAAAT<br>GAACAGCCTGAGAGCCGAGGACACGGCTGTTTATTTCTGTGCGAGAGCA<br>CCTCTTTTACCCGCTATGATGGACCTCTGGGGCCAAGGGACCACGGTCAC<br>CGTCTCCTCA |
| 144 | 2290 | 322 | QVQLVQSGGGLVKPGGSLRLSCAASGFTISGYNMFWVRQPPGKGLEWVSSI<br>TAGSSYLNYADSVKGRFIVSRDNAKNSLYLQMNSLRAEDTAVYFCARAPLL<br>PAMMDLWGQGTTVTVSS |
| 144 | 2291 | 323 | FTISGYNMF |
| 144 | 2292 | 324 | TTCACCATCAGTGGTTATAACATGTTC |
| 144 | 2293 | 325 | SITAGSSYLNYADSVKG |
| 144 | 2294 | 326 | TCCATTACTGCTGGTAGTAGTTATTTAAACTATGCAGACTCAGTGAAGGG<br>C |
| 144 | 2295 | 327 | ARAPLLPAMMDL |
| 144 | 2296 | 328 | GCGAGAGCACCTCTTTTACCCGCTATGATGGACCTC |

TABLE 6-continued

Informal Sequence Listing

| Antibody No. | Seq. Ref. No. | SEQ ID NO. | Sequence |
|---|---|---|---|
| 144 | 2297 | 329 | CAGTCTGTCTTGACGCAGCCGCCCTCAGTGTCTGGGGCCCCAGGGCAGA GGGTCACCATCTCCTGCACTGGGAGCAGCTCCAACATCGGGGCAGGTTA TGATGTACACTGGTACCAGCAACTTCCAGGAACAGCCCCCAAACTCCTC ATCTATACTAACAACAATCGGCCCTCAGGGGTCCCTGACCGATTCTCTGG CTCCAAGTCTGGCACCTCAGCCTCCCTGGCCATCACTGGGCTCCAGGCTG AGGATGAGGCTGACTATTACTGCCAGTCCTATGACAGAAGCCTGAATGG TTATGTCTTCGGAACTGGGACCAAGCTCACCGTCCTA |
| 144 | 2298 | 330 | QSVLTQPPSVSGAPGQRVTISCTGSSSNIGAGYDVHWYQQLPGTAPKLLIYT NNNRPSGVPDRFSGSKSGTSASLAITGLQAEDEADYYCQSYDRSLNGYVFG TGTKLTVL |
| 144 | 2299 | 331 | TGSSSNIGAGYDVH |
| 144 | 2300 | 332 | ACTGGGAGCAGCTCCAACATCGGGGCAGGTTATGATGTACAC |
| 144 | 2301 | 333 | TNNNRPS |
| 144 | 2302 | 334 | ACTAACAACAATCGGCCCTCA |
| 144 | 2303 | 335 | QSYDRSLNGYV |
| 144 | 2304 | 336 | CAGTCCTATGACAGAAGCCTGAATGGTTATGTC |
| 145 | 2305 | 337 | CAGGTCCAGCTTGTACAGTCTGGGGCTGAGGTGAAGAAGCCTGGGGCCT CACTGATGGTCTCCTGCTCGGCTTCTGGATACATTTTCAACAGTGACATC AACTGGGTGCGACAGGCCCCTGGACAAGGGCTTGAGTGGATGGGGTGG ATGAACCCTAAGAATGGTCACACAGGCTATGCACAGGAATTCGAGGGCA GAGTCAGCATGACCAGGAACTCCTCCAAAACTATTGCCTATCTGCAGCT GAGCAGCCTGACATATGAAGACACGGCCGTCTATTATTGTGTTTACGATT TCTGGAGTGATGATTCAGTCAAGTGGGGCCGGGGAACCCTGGTCACCGT CTCCTCA |
| 145 | 2306 | 338 | QVQLVQSGAEVKKPGASLMVSCSASGYIFNSDINWVRQAPGQGLEWMGW MNPKNGHTGYAQEFEGRVSMTRNSSKTIAYLQLSSLTYEDTAVYYCVYDF WSDDSVKWGRGTLVTVSS |
| 145 | 2307 | 339 | YIFNSDIN |
| 145 | 2308 | 340 | TACATTTTCAACAGTGACATCAAC |
| 145 | 2309 | 341 | WMNPKNGHTGYAQEFEG |
| 145 | 2310 | 342 | TGGATGAACCCTAAGAATGGTCACACAGGCTATGCACAGGAATTCGAGG GC |
| 145 | 2311 | 343 | VYDFWSDDSVK |
| 145 | 2312 | 344 | GTTTACGATTTCTGGAGTGATGATTCAGTCAAG |
| 145 | 2313 | 345 | CAGTCTGTGGTGACGCAGCCGCCCTCAGTGTCTGGGGCCCCAGGGCAGA GTGTCGCCATCTCCTGCTCTGGGAGCAGCTCCAACATCGGGCAGGTTAT GATGTACACTGGTACCAGCAACTTCCGGGATCAGCCCCCAAAACTCCTCA TCTACGGTGACAACAATCGGCCCTCAGGGGTCCCTGAGCGATTCTCTACC TCCAAGTCTGGCACCTCAGCCTCACTGGCCATCACTGGGCTCCAGGCTGA GGATGAGGCTGATTATTACTGCCAGTCCTTTGACAGCAGCCTGCGTGGTT ATGTCTTCGGAACTGGGACCAAGGTGACCGTCCTA |
| 145 | 2314 | 346 | QSVVTQPPSVSGAPGQSVAISCSGSSSNIGPGYDVHWYQQLPGSAPKLLIYG DNNRPSGVPERFSTSKSGTSASLAITGLQAEDEADYYCQSFDSSLRGYVFGT GTKVTVL |
| 145 | 2315 | 347 | SGSSSNIGPGYDVH |
| 145 | 2316 | 348 | TCTGGGAGCAGCTCCAACATCGGGCCAGGTTATGATGTACAC |
| 145 | 2317 | 349 | GDNNRPS |
| 145 | 2318 | 350 | GGTGACAACAATCGGCCCTCA |
| 145 | 2319 | 351 | QSFDSSLRGYV |
| 145 | 2320 | 352 | CAGTCCTTTGACAGCAGCCTGCGTGGTTATGTC |

TABLE 6-continued

Informal Sequence Listing

| Antibody No. | Seq. Ref. No. | SEQ ID NO. | Sequence |
|---|---|---|---|
| 146 | 2321 | 353 | CAGGTCCAGCTGGTACAGTCTGGAGCAGCGGTGAAAAAGCCCGGGGAG<br>TCTCTGAAGATCTCCTGTAAGGGTTTTGGATACAGCTTTACCAAGTATTG<br>GATCGGCTGGGTGCGCCAGGTGCCCGGGAAAGGCCTGGAGTGGATAGG<br>GATCATCTCTCCTACTGACTCTAATACCAGATACAGCCCGTCCTTCCGAG<br>GCCAGGTCACCATGTCAGCCGACAAGTCCATCAGTGCCGCCTACCTGCA<br>GTGGAGCAGCCTGAAGGCCTCGGACACCGCCATGTATTACTGTGCGAGA<br>CACAGCAGTCCGTATAGCAGTGGCTGGTACGGAGATACATACTTCTTTG<br>ACTCCTGGGGCCAGGGAACCCTGGTCACCGTCTCCTCA |
| 146 | 2322 | 354 | QVQLVQSGAAVKKPGESLKISCKGFGYSFTKYWIGWVRQVPGKGLEWIGII<br>SPTDSNTRYSPSFRGQVTMSADKSISAAYLQWSSLKASDTAMYYCARHSSP<br>YSSGWYGDTYFFDSWGQGTLVTVSS |
| 146 | 2323 | 355 | YSFTKYWIG |
| 146 | 2324 | 356 | TACAGCTTTACCAAGTATTGGATCGGC |
| 146 | 2325 | 357 | IISPTDSNTRYSPSFRG |
| 146 | 2326 | 358 | ATCATCTCTCCTACTGACTCTAATACCAGATACAGCCCGTCCTTCCGAGG<br>C |
| 146 | 2327 | 359 | ARHSSPYSSGWYGDTYFFDS |
| 146 | 2328 | 360 | GCGAGACACAGCAGTCCGTATAGCAGTGGCTGGTACGGAGATACATACT<br>TCTTTGACTCC |
| 146 | 2329 | 361 | CAGCCTGTGCTGACTCAGCCACCCTCAGCGTCTGGGACCCCCGGGCAGA<br>GGGTCACCATCTCTTGTTCTGGAAGCAACTCCAACATCGGGACTAATACT<br>GTGAACTGGTACCAGCAGCTCCCTGGAACGGCCCCCAAAGTCCTCATCC<br>ATAATAATAATGAGCGGCCCTCAGGGGTCCCTGACCGATTCTCTGGCTCC<br>AAGTCTGGCACCTCAGCCTCCCTGGCCATCAGTGGGCTCCAGTCTGAGG<br>ATGAGGCTGATTATTACTGTGCAGCATGGGATGACAGCCTGAGAGGTTA<br>TGTCTTCGGAACTGGGACCAAGGTGACCGTCCTA |
| 146 | 2330 | 362 | QPVLTQPPSASGTPGQRVTISCSGSNSNIGTNTVNWYQQLPGTAPKVLIHNN<br>NERPSGVPDRFSGSKSGTSASLAISGLQSEDEADYYCAAWDDSLRGYVFGT<br>GTKVTVL |
| 146 | 2331 | 363 | SGSNSNIGTNTVN |
| 146 | 2332 | 364 | TCTGGAAGCAACTCCAACATCGGGACTAATACTGTGAAC |
| 146 | 2333 | 365 | NNNERPS |
| 146 | 2334 | 366 | AATAATAATGAGCGGCCCTCA |
| 146 | 2335 | 367 | AAWDDSLRGYV |
| 146 | 2336 | 368 | GCAGCATGGGATGACAGCCTGAGAGGTTATGTC |
| 147 | 2337 | 369 | CAGGTGCAGCTGGTGCAATCTGGGGCTGAGGTGAAGAAGCCTGGGTCCT<br>CGGTGAAGGTCTCCTGCAAGGCTTCTGGAGGCACCTTCGGCAGCTATGC<br>TATCAGCTGGGTGCGACAGGCCCCTGGACAAGGACTTGAGTGGATGGGA<br>GGGACCATCCCTATCTTTGGTACAGCAGACCACGCACAGAAGTTCCAGG<br>GCAGAGTCACGATAACCGCGGACAAATCCACGAGCACAGCGTACATGG<br>AACTGAGCAGCCTGAGATCTGAGGACACGGCCGTGTATTACTGTGCGAG<br>AGGTGTTTTCCGCGTAGGTTGTAGTGATACCAGCTGCCTCAAAAACTACT<br>ACGGTACGGACGTCTGGGGCCAAGGGACCACGGTCACCGTCTCCTCA |
| 147 | 2338 | 370 | QVQLVQSGAEVKKPGSSVKVSCKASGGTFGSYAISWVRQAPGQGLEWMG<br>GTIPIFGTADHAQKFQGRVTITADKSTSTAYMELSSLRSEDTAVYYCARGVF<br>RVGCSDTSCLKNYYGTDVWGQGTTVTVSS |
| 147 | 2339 | 371 | GTFGSYAIS |
| 147 | 2340 | 372 | GGCACCTTCGGCAGCTATGCTATCAGC |
| 147 | 2341 | 373 | GTIPIFGTADHAQKFQG |
| 147 | 2342 | 374 | GGGACCATCCCTATCTTTGGTACAGCAGACCACGCACAGAAGTTCCAGG<br>GC |
| 147 | 2343 | 375 | ARGVFRVGCSDTSCLKNYYGTDV |

TABLE 6-continued

Informal Sequence Listing

| Antibody No. | Seq. Ref. No. | SEQ ID NO. | Sequence |
|---|---|---|---|
| 147 | 2344 | 376 | GCGAGAGGTGTTTTCCGCGTAGGTTGTAGTGATACCAGCTGCCTCAAAA<br>ACTACTACGGTACGGACGTC |
| 147 | 2345 | 377 | CAGTCTGTTCTGATTCAGCCTGCCTCCGTGTCTGGGTCTCCTGGACAGTC<br>GATCACCGTCTCCTGCACTGGATCCAGCGGTGACGTTGGTGCTTATAAGT<br>ATGTCTCCTGGTACCAACAACACCCAGGCAGAGGCCCCAAACTCATAAT<br>TTATGATGTCAGTGCTCGGCCCTCAGGGATTTCTGATCGCTTCTCTGGCT<br>CCAAGTCTGGCAACACGGCCTCCCTGACCATCTCTGGGCTCCAGGCTGA<br>GGACGAGGCTGACTATTACTGCAGCTCATATTCAAGCAGCAGCACTCTC<br>GTAGTATTCGGCGGAGGGACCAAGGTGACCGTCCTA |
| 147 | 2346 | 378 | QSVLIQPASVSGSPGQSITVSCTGSSGDVGAYKYVSWYQQHPGRGPKLIIYD<br>VSARPSGISDRFSGSKSGNTASLTISGLQAEDEADYYCSSYSSSSTLVVFGGG<br>TKVTVL |
| 147 | 2347 | 379 | TGSSGDVGAYKYVS |
| 147 | 2348 | 380 | ACTGGATCCAGCGGTGACGTTGGTGCTTATAAGTATGTCTCC |
| 147 | 2349 | 381 | DVSARPS |
| 147 | 2350 | 382 | GATGTCAGTGCTCGGCCCTCA |
| 147 | 2351 | 383 | SSYSSSSTLVV |
| 147 | 2352 | 384 | AGCTCATATTCAAGCAGCAGCACTCTCGTAGTA |
| 148 | 2353 | 385 | CAGGTCCAGCTGGTGCAGTCTGGGGGAGGGTTGGTGCAGCCTGGGGGGT<br>CCCTGAGACTCTCTTGTGTAGGCTCTGGATTCACCTTCAGTACCTATAGT<br>ATGAACTGGGTCCGTCAGGCTCCAGGGAAGGGGCTGGAGTGGGTTTCAC<br>ACATTAGTAGTAGTAGTGTTACCATGTACTACGCAGACTTTGTGAAGGG<br>CCGATTCACCATCTCCAGAGACAATGCCAAGAACTCACTGTATCTGCAA<br>ATGACCAGCCTGAGAGCCGAGGACACGGCTGTGTATTACTGTGCGAGAG<br>ATGCGGGACCAGTTTGGAGTGGTTATTACGACTACGGTATGGACGTCTG<br>GGGCCAAGGGACCACGGTCACTGTCTCCTCA |
| 148 | 2354 | 386 | QVQLVQSGGGLVQPGGSLRLSCVGSGFTFSTYSMNWVRQAPGKGLEWVSH<br>ISSSSVTMYYADFVKGRFTISRDNAKNSLYLQMTSLRAEDTAVYYCARDAG<br>PVWSGYYDYGMDVWGQGTTVTVSS |
| 148 | 2355 | 387 | FTFSTYSMN |
| 148 | 2356 | 388 | TTCACCTTCAGTACCTATAGTATGAAC |
| 148 | 2357 | 389 | HISSSSVTMYYADFVKG |
| 148 | 2358 | 390 | CACATTAGTAGTAGTAGTGTTACCATGTACTACGCAGACTTTGTGAAGG<br>GC |
| 148 | 2359 | 391 | ARDAGPVWSGYYDYGMDV |
| 148 | 2360 | 392 | GCGAGAGATGCGGGACCAGTTTGGAGTGGTTATTACGACTACGGTATGG<br>ACGTC |
| 148 | 2361 | 393 | GAAACGACACTCACGCAGTCTCCAGCCACGCTGTCTTTGTCTCCAGGGG<br>AAAGAGCCACCCTCTCCTGCAGGGCCAGTCAGAGTGTTAGCAGCCTCTT<br>AGCCTGGTACCAACAGAAACCTGGCCAGGCTCCCAGGCTCCTCATTTTTG<br>ATGCATCCAAGAGGGCCACTGGCATCCCAGCCAGGTTCAGTGGCAGTGG<br>GTCTGGGACAGACTTCACTCTCACCATCAGCAGCCTAGAGCCTGAAGAT<br>TTTGCAGTCTATTACTGTCAGCAGCGTTACAACTGGCCTCCGCTCACTTT<br>CGGCGGAGGGACCAAGGTGGAAATCAAA |
| 148 | 2362 | 394 | ETTLTQSPATLSLSPGERATLSCRASQSVSSLLAWYQQKPGQAPRLLIFDASK<br>RATGIPARFSGSGSGTDFTLTISSLEPEDFAVYYCQQRYNWPPLTFGGGTKV<br>EIK |
| 148 | 2363 | 395 | RASQSVSSLLA |
| 148 | 2364 | 396 | AGGGCCAGTCAGAGTGTTAGCAGCCTCTTAGCC |
| 148 | 2365 | 397 | DASKRAT |
| 148 | 2366 | 398 | GATGCATCCAAGAGGGCCACT |

TABLE 6-continued

Informal Sequence Listing

| Antibody No. | Seq. Ref. No. | SEQ ID NO. | Sequence |
|---|---|---|---|
| 148 | 2367 | 399 | QQRYNWPPLT |
| 148 | 2368 | 400 | CAGCAGCGTTACAACTGGCCTCCGCTCACT |
| 149 | 2369 | 401 | GAGGTGCAGCTGGTGGAGTCTGGGGGAGGCTTGGTCCAGCCTGGCAGGT<br>CCCTGAGACTCTCCTGTGCAGCCTTTGGATTCACCTTTGATGATTATGCC<br>ATGCACTGGGTCCGGCAAGCTCCAGGGAAGGGCCTGGAGTGGGTCTCAG<br>GTATTAGTTGGAATAGTGGTTTCATAGGCTATGCGGACTCTGTGAAGGG<br>CCGATTCACCATCTCCAGAGACAATGCCAAGAACTCCCTGTCTCTGCAA<br>ATGAACAGTCTGAGAACTGAGGATACGGCCTTGTATTACTGTGCAAAAA<br>CTGATGGAGCAGTGGCTGTCGACGGGCCCTTTGACTACTGGGGCCAGGG<br>AACCCTGGTCACCGTCTCCTCA |
| 149 | 2370 | 402 | EVQLVESGGGLVQPGRSLRLSCAAFGFTFDDYAMHWVRQAPGKGLEWVS<br>GISWNSGFIGYADSVKGRFTISRDNAKNSLSLQMNSLRTEDTALYYCAKTD<br>GAVAVDGPFDYWGQGTLVTVSS |
| 149 | 2371 | 403 | FTFDDYAMH |
| 149 | 2372 | 404 | TTCACCTTTGATGATTATGCCATGCAC |
| 149 | 2373 | 405 | GISWNSGFIGYADSVKG |
| 149 | 2374 | 406 | GGTATTAGTTGGAATAGTGGTTTCATAGGCTATGCGGACTCTGTGAAGG<br>GC |
| 149 | 2375 | 407 | AKTDGAVAVDGPFDY |
| 149 | 2376 | 408 | GCAAAAACTGATGGAGCAGTGGCTGTCGACGGGCCCTTTGACTAC |
| 149 | 2377 | 409 | GAAATTGTGTTGACACAGTCTCCATCCTCCCTGTCTGCATCTGTAGGAGA<br>CAGAGTCACCATCACTTGCCGGGCAAGTCAGAGCATTAGCGGCTATTTA<br>AGTTGGTATCAGCAGAAACCAGGGAAAGCCCCTAAGCTCCTGATCCATT<br>CTACATCTAGTTTGCAAAGTGGGGTCCCATCAAGGTTCAGTGGCAGTGG<br>ATCTGGGACAGATTTCACTCTCACCATCACCAGTCTGCAACCTGAGGATT<br>TTGCAACTTACTACTGTCAACAGAGTTACATTGCCCCTCCGACTTTTGGC<br>CAGGGGACCAAGGTGGAAATCAAA |
| 149 | 2378 | 410 | EIVLTQSPSSLSASVGDRVTITCRASQSISGYLSWYQQKPGKAPKLLIHSTSSL<br>QSGVPSRFSGSGSGTDFTLTITSLQPEDFATYYCQQSYIAPPTFGQGTKVEIK |
| 149 | 2379 | 411 | RASQSISGYLS |
| 149 | 2380 | 412 | CGGGCAAGTCAGAGCATTAGCGGCTATTTAAGT |
| 149 | 2381 | 413 | STSSLQS |
| 149 | 2382 | 414 | TCTACATCTAGTTTGCAAAGT |
| 149 | 2383 | 415 | QQSYIAPPT |
| 149 | 2384 | 416 | CAACAGAGTTACATTGCCCCTCCGACT |
| 150 | 2385 | 417 | CAGGTCCAGCTGGTACAGTCTGGGGCTGAGGTGAAGAAGCCTGGGTCCT<br>CGATGAAGGTCTCCTGCCAGGCTTCTGGAGGCCCCTTCAGCACCTATACT<br>ATCAGCTGGGTGCGACAGGCCCCTGGACAAGGGCTTGAGTGGATGGGAG<br>GTATCATCCCTGTCTTTGGTACACCAAACTACGCGCAGAAGTTCCACGGC<br>AGAGTCACGATTACCGCGGACCAATCCACGAGCACAGCCTACATGGAGT<br>TGAGTAGCCTGAGATCTGAGGACACCGCCGTTTATTACTGTGCGGGAGC<br>CCCCTACCCTATGGACGTCTGGGGCCAAGGGACCACGGTCACCGTCTCC<br>TCA |
| 150 | 2386 | 418 | QVQLVQSGAEVKKPGSSMKVSCQASGGPFSTYTISWVRQAPGQGLEWMGG<br>IIPVFGTPNYAQKFHGRVTITADQSTSTAYMELSSLRSEDTAVYYCAGAPYP<br>MDVWGQGTTVTVSS |
| 150 | 2387 | 419 | GPFSTYTIS |
| 150 | 2388 | 420 | GGCCCCTTCAGCACCTATACTATCAGC |
| 150 | 2389 | 421 | GIIPVFGTPNYAQKFHG |

TABLE 6-continued

Informal Sequence Listing

| Antibody No. | Seq. Ref. No. | SEQ ID NO. | Sequence |
|---|---|---|---|
| 150 | 2390 | 422 | GGTATCATCCCTGTCTTTGGTACACCAAACTACGCGCAGAAGTTCCACGGC |
| 150 | 2391 | 423 | AGAPYPMDV |
| 150 | 2392 | 424 | GCGGGAGCCCCCTACCCTATGGACGTC |
| 150 | 2393 | 425 | GAAATTGTATTGACACAGTCTCCAGCCACCCTGTCTTTGTCTCCAGGGGAGAGAGCCACCCTCTCCTGCAGGGCCAGTCAGAGTGTTGCCAGCTCCTTAGCCTGGTACCAACAGAAACCTGGCCAGGCTCCCAGGCTCCTCATCTATGATGCATCCAACAGGGCCACTGGCATCCCAGCCAGGTTCAGTGGCAGTGGGTCTGGGACAGACTTCACTCTCACCATCAGCAGCCTAGAGCCTGAAGATTTTGCAGTTTATTACTGTCAGCAGCGTACCAACTGGCAGGGGCTCTCTTTCGGCGGAGGGACCAAAGTGGATATCAAA |
| 150 | 2394 | 426 | EIVLTQSPATLSLSPGERATLSCRASQSVASSLAWYQQKPGQAPRLLIYDASNRATGIPARFSGSGSGTDFTLTISSLEPEDFAVYYCQQRTNWQGLSFGGGTKVDIK |
| 150 | 2395 | 427 | RASQSVASSLA |
| 150 | 2396 | 428 | AGGGCCAGTCAGAGTGTTGCCAGCTCCTTAGCC |
| 150 | 2397 | 429 | DASNRAT |
| 150 | 2398 | 430 | GATGCATCCAACAGGGCCACT |
| 150 | 2399 | 431 | QQRTNWQGLS |
| 150 | 2400 | 432 | CAGCAGCGTACCAACTGGCAGGGGCTCTCT |
| 151 | 2401 | 433 | CAGGTCCAGCTTGTGCAGTCTGGAGGTGAGGTCAAGAAGCCTGGGGCCTCAGTGAAGGTCTCCTGCAAGGCTTCTGGTTACACCTTTATCAGTTATGGTATCACCTGGGTGCGACAGGCCCCTGGACAAGGGCCTGAGTGGATGGGATGGATCAGCCCTTACAACGGTGACACAAACTATGCACAGAAGCTCCAGGGCAGAGTCACCATGACCACAGACACATCCACGACCACAGCCTACATGGAACTGAGGAGCCTGAGATCTGACGACACGGCCATATATTATTGTGCGAGACGGTACGATATTTTGACTGGCGGGGGCTGGTTCGACTCCTGGGGCCAGGGAACCCTGGTCACCGTCTCCTCA |
| 151 | 2402 | 434 | QVQLVQSGGEVKKPGASVKVSCKASGYTFISYGITWVRQAPGQGPEWMGWISPYNGDTNYAQKLQGRVTMTTDTSTTTAYMELRSLRSDDTAIYYCARRYDILTGGGWFDSWGQGTLVTVSS |
| 151 | 2403 | 435 | YTFISYGIT |
| 151 | 2404 | 436 | TACACCTTTATCAGTTATGGTATCACC |
| 151 | 2405 | 437 | WISPYNGDTNYAQKLQG |
| 151 | 2406 | 438 | TGGATCAGCCCTTACAACGGTGACACAAACTATGCACAGAAGCTCCAGGGC |
| 151 | 2407 | 439 | ARRYDILTGGGWFDS |
| 151 | 2408 | 440 | GCGAGACGGTACGATATTTTGACTGGCGGGGGCTGGTTCGACTCC |
| 151 | 2409 | 441 | GATATTGTGATGACTCAGTCTCCTTCCTCCCTGTCTGCATCTGTAGGAGACAGAGTCACCATCAATTGCCGGGCAAGTCAGAGCATTATCAGCTATTTAAATTGGTATCAGCAAAAACCAGGGAAAGCCCCTGAGCTCCTAATCTATGCTGCGTCCAGTTTGCAAAGTGGGGTCCCATCAAGGTTCAGTGGCAGTGGATCTGGGACAGAGTTCACTCTCACCATCAGCAGTCTGCAACCTGAAGATTTTGCAACGTACTACTGTCAACAGAGTTACAGTACCCCTCTTAGTTTCGGCCCTGGGACCAAGGTGGAGATCAAA |
| 151 | 2410 | 442 | DIVMTQSPSSLSASVGDRVTINCRASQSIISYLNWYQQKPGKAPELLIYAASSLQSGVPSRFSGSGSGTEFTLTISSLQPEDFATYYCQQSYSTPLSFGPGTKVEIK |
| 151 | 2411 | 443 | RASQSIISYLN |
| 151 | 2412 | 444 | CGGGCAAGTCAGAGCATTATCAGCTATTTAAAT |
| 151 | 2413 | 445 | AASSLQS |

TABLE 6-continued

Informal Sequence Listing

| Antibody No. | Seq. Ref. No. | SEQ ID NO. | Sequence |
|---|---|---|---|
| 151 | 2414 | 446 | GCTGCGTCCAGTTTGCAAAGT |
| 151 | 2415 | 447 | QQSYSTPLS |
| 151 | 2416 | 448 | CAACAGAGTTACAGTACCCCTCTTAGT |
| 152 | 2417 | 449 | CAGGTCCAGCTTGTGCAGTCTGGAGCAGAGGTGAAAAAGCCCGGGGAGT CTCTGAAGATCTCCTGTAAGACTTCTGGATACAAATTTACCAATTACTGG ATCGGCTGGGTGCGCCAGATGCCCGGGAAAGGCCTGGAGTGGATGGGG ATCATCTATCCTGGTGACTCTGATGCCAGATACAGCCCGTCCTTCCAAGG CCAGGTCACCTTCTCAGCCGACAAGTCCATCAGCACCGCCTACCTGCAGT GGAGCAGCCTGAAGGCCTCGGACACCGCCATGTATTACTGTGCGAGACA AGATAACAGTGGCTGGGCCGACTTCTTTCCCTTTGACTACTGGGGCCAGG GAACCCTGGTCACCGTCTCCTCA |
| 152 | 2418 | 450 | QVQLVQSGAEVKKPGESLKISCKTSGYKFTNYWIGWVRQMPGKGLEWMGI IYPGDSDARYSPSFQGQVTFSADKSISTAYLQWSSLKASDTAMYYCARQDN SGWADFFPFDYWGQGTLVTVSS |
| 152 | 2419 | 451 | YKFTNYWIG |
| 152 | 2420 | 452 | TACAAATTTACCAATTACTGGATCGGC |
| 152 | 2421 | 453 | IYPGDSDARYSPSFQG |
| 152 | 2422 | 454 | ATCATCTATCCTGGTGACTCTGATGCCAGATACAGCCCGTCCTTCCAAGG C |
| 152 | 2423 | 455 | ARQDNSGWADFFPFDY |
| 152 | 2424 | 456 | GCGAGACAAGATAACAGTGGCTGGGCCGACTTCTTTCCCTTTGACTAC |
| 152 | 2425 | 457 | GAAACGACACTCACGCAGTCTCCAGGCACCCTGTCTTTGTCTCCAGGGG AAAGAGCCACCCTCTCCTGCAGGGCCAGTCACAGTTTTAGCAGCAGCTA CTTAGCCTGGTACCAGCAGAAACCTGGCCAGGCTCCCAGGCTCCTCATCT ATGCTGCATCCAACAGGGCCACTGGCATCCCAGACAGGTTCAGTGGCAG TGGGTCTGGGACAGACTTCACTCTCACCATCAGCAGACTGGAGCCTGAA GATTTTGCAGTGTATTTCTGTCAGCAGTATGATAGCTCACCGTGGACGTT CGGCCAAGGGACCAAGGTGGAGATCAAA |
| 152 | 2426 | 458 | ETTLTQSPGTLSLSPGERATLSCRASHSFSSSYLAWYQQKPGQAPRLLIYAAS NRATGIPDRFSGSGSGTDFTLTISRLEPEDFAVYFCQQYDSSPWTFGQGTKVE IK |
| 152 | 2427 | 459 | RASHSFSSSYLA |
| 152 | 2428 | 460 | AGGGCCAGTCACAGTTTTAGCAGCAGCTACTTAGCC |
| 152 | 2429 | 461 | AASNRAT |
| 152 | 2430 | 462 | GCTGCATCCAACAGGGCCACT |
| 152 | 2431 | 463 | QQYDSSPWT |
| 152 | 2432 | 464 | CAGCAGTATGATAGCTCACCGTGGACG |
| 153 | 2433 | 465 | GAGGTGCAGCTGGTGGAGTCTGGGGGAGGCGTGGTCCAGCCTGGGAAAT CCCTGAGACTCTCCTGTGCCGCGTCGGGATTCATCTTCAGTGGCTATGGC ATGCACTGGGTCCGCCAGGCTCCAGGCAAGGGGCTGGAGTGGGTGGCGT TTATATGGTTTGATGGAAGTTCTACATATTATGCAGACTCCGTGAAGGGC CGTTTCACCATCTCCAAAGACGATTCCAAGCAGACGGTATATTTGCAAAT GAACAGGCTGAGAGCCGAGGACACGGCTGTCTACTACTGTGCGAGAGAC CCCTTATTTTTATACAATTATAATGACGAACCTTTTGACTACTGGGGACA GGGAACCCTGGTCACCGTCTCCTCA |
| 153 | 2434 | 466 | EVQLVESGGVVQPGKSLRLSCAASGFIFSGYGMHWVRQAPGKGLEWVAF IWFDGSSTYYADSVKGRFTISKDDSKQTVYLQMNRLRAEDTAVYYCARDPL FLYNYNDEPFDYWGQGTLVTVSS |
| 153 | 2435 | 467 | FIFSGYGMH |
| 153 | 2436 | 468 | TTCATCTTCAGTGGCTATGGCATGCAC |

TABLE 6-continued

Informal Sequence Listing

| Antibody No. | Seq. Ref. No. | SEQ ID NO. | Sequence |
|---|---|---|---|
| 153 | 2437 | 469 | FIWFDGSSTYYADSVKG |
| 153 | 2438 | 470 | TTTATATGGTTTGATGGAAGTTCTACATATTATGCAGACTCCGTGAAGGGC |
| 153 | 2439 | 471 | ARDPLFLYNYNDEPFDY |
| 153 | 2440 | 472 | GCGAGAGACCCCTTATTTTTATACAATTATAATGACGAACCTTTTGACTAC |
| 153 | 2441 | 473 | TCCTATGAGCTGACACAGCCACCCTCAGCGTCTGGTTCCCCCGGGCAGAGCGTCACCATCTCTTGTTCTGGAAGCAGCTCCAATATCGGGGGTAATTTTGTGTACTGGTACCAGCAACTGCCCGGAACGGCCCCCAAAGTCCTCATCTATAGGAATAATCAGCGGCCCTCAGGGGTCCCTGACCGATTCTCTGGCTCCAAGTCTGGCACTTCAGCCTCCCTGGCCATCAGTGGGCTCCGGTCCGACGATGAGGCTGATTATTATTGTTCAGTATGGGATGACAGCCTAAATGGTCGGCTGTTCGGCGGAGGGACCAAGCTGACCGTCCTA |
| 153 | 2442 | 474 | SYELTQPPSASGSPGQSVTISCSGSSSNIGGNFVYWYQQLPGTAPKVLIYRNNQRPSGVPDRFSGSKSGTSASLAISGLRSDDEADYYCSVWDDSLNGRLFGGGTKLTVL |
| 153 | 2443 | 475 | SGSSSNIGGNFVY |
| 153 | 2444 | 476 | TCTGGAAGCAGCTCCAATATCGGGGGTAATTTTGTGTAC |
| 153 | 2445 | 477 | RNNQRPS |
| 153 | 2446 | 478 | AGGAATAATCAGCGGCCCTCA |
| 153 | 2447 | 479 | SVWDDSLNGRL |
| 153 | 2448 | 480 | TCAGTATGGGATGACAGCCTAAATGGTCGGCTG |
| 154 | 2449 | 481 | GAGGTGCAGCTGGTGGAGTCTGGGGGAGGTGTGGTCCGGCCTGGGGGGTCCCTGAGACTCTCCTGTGCAGCCTCTGGATTCAAGTTTGATGATTATGGCATGAGCTGGGTCCGCCAAGCTCCAGGGAAGGGGCTGGAGTGGGTCTCTGCAATTATTTGGAATAGTGGTAGCACAGGTTATGCAGACTCTGTGAAGGGCCGATTCATCATCTCCAGAGACAACGCCAAGAACTCCCTGTATCTGCAAATGAATAGTCTGAGAGCCGAAGACACGGCCTTGTATTACTGTGCGAGAGTCGGGGGGATAACGAAGTGGTGGTACTACGGTATGGACCTCTGGGGCCAAGGGACCACGGTCACCGTCTCCTCA |
| 154 | 2450 | 482 | EVQLVESGGGVVRPGGSLRLSCAASGFKFDDYGMSWVRQAPGKGLEWVSAIIWNSGSTGYADSVKGRFIISRDNAKNSLYLQMNSLRAEDTALYYCARVGGITKWWYYGMDLWGQGTTVTVSS |
| 154 | 2451 | 483 | FKFDDYGMS |
| 154 | 2452 | 484 | TTCAAGTTTGATGATTATGGCATGAGC |
| 154 | 2453 | 485 | AIIWNSGSTGYADSVKG |
| 154 | 2454 | 486 | GCAATTATTTGGAATAGTGGTAGCACAGGTTATGCAGACTCTGTGAAGGGC |
| 154 | 2455 | 487 | ARVGGITKWWYYGMDL |
| 154 | 2456 | 488 | GCGAGAGTCGGGGGGATAACGAAGTGGTGGTACTACGGTATGGACCTC |
| 154 | 2457 | 489 | GAAACGACACTCACGCAGTCTCCATCCTTCCTGTCTGCATCTGTCGGAGACAGAGTCACCATCACTTGCCGGGCCAGTCAGGGCTTGAGCAATTATTTAGCCTGGTATCAGAAAACCAGGGAGAGCCCCAAGCTCCTGATCTATGCTGCATCCACTTTGCAAAGTGGGGTCCCATCAAGGTTCAGAGGCAGTGGATCTGGGACAGAGTTCACTCTCACAATCAGCAGCCTGCAGCCTGAAGATCTTGCAACTTATTACTGTCAACACCTTAATAGTTACCCTCTCACTTTCGGCGGAGGGACCAAGGTGGAGATCAAA |
| 154 | 2458 | 490 | ETTLTQSPSFLSASVGDRVTITCRASQGLSNYLAWYQQKPGRAPKLLIYAASTLQSGVPSRFRGSGSGTEFTLTISSLQPEDLATYYCQHLNSYPLTFGGGTKVEIK |
| 154 | 2459 | 491 | RASQGLSNYLA |

TABLE 6-continued

Informal Sequence Listing

| Antibody No. | Seq. Ref. No. | SEQ ID NO. | Sequence |
|---|---|---|---|
| 154 | 2460 | 492 | CGGGCCAGTCAGGGCTTGAGCAATTATTTAGCC |
| 154 | 2461 | 493 | AASTLQS |
| 154 | 2462 | 494 | GCTGCATCCACTTTGCAAAGT |
| 154 | 2463 | 495 | QHLNSYPLT |
| 154 | 2464 | 496 | CAACACCTTAATAGTTACCCTCTCACT |
| 155 | 2465 | 497 | GAGGTGCAGCTGGTGGAGTCGGGCCCCGGACTGGTGAAGCCTTCGGAGA CCCTGTCCCTCATCTGCAGAGTCTTTGGTGGGTCCGTCAGGAGGGGGA CTACAACTGGAATTGGATCCGGCAGCCCCCAGGGAAGGGACTGGAGTGG ATTGGCTATATCGATTATAGTGGGACCACCAAGTACAATCCCTCCCTCAA GAGCCGAGTGACCATATCAGAAGACACGTCCAGGAATCAGTTCTCCCTG GAGCTGAGGTCTGTGACCGCCGCGGACACGGCCATGTATTACTGTGCGA GAGACGTTGGAAGTACTCCCTACAACTATTACGGTATGGACGTCTGGGG CCAAGGGACCACGGTCACCGTCTCCTCA |
| 155 | 2466 | 498 | EVQLVESGPGLVKPSETLSLICRVFGGSVRRGDYNWNWIRQPPGKGLEWIG YIDYSGTTKYNPSLKSRVTISEDTSRNQFSLELRSVTAADTAMYYCARDVGS TPYNYYGMDVWGQGTTVTVSS |
| 155 | 2467 | 499 | GSVRRGDYNWN |
| 155 | 2468 | 500 | GGGTCCGTCAGGAGGGGGGACTACAACTGGAAT |
| 155 | 2469 | 501 | YIDYSGTTKYNPSLKS |
| 155 | 2470 | 502 | TATATCGATTATAGTGGGACCACCAAGTACAATCCCTCCCTCAAGAGC |
| 155 | 2471 | 503 | ARDVGSTPYNYYGMDV |
| 155 | 2472 | 504 | GCGAGAGACGTTGGAAGTACTCCCTACAACTATTACGGTATGGACGTC |
| 155 | 2473 | 505 | GAAATTGTGTTGACGCAGTCTCCAGGCACCCTGTCCTTGTCTCCAGGGGA AAGAGCCACCCTCTCCTGTAGGGCCAGTCAGACTATTAAAAACAACTAC TTAGCCTGGTACCAACAGAAACCTGGCCAGGCTCCCAGGCTCCTCATGT ATGGTGTATCCAGCAGGCCGACTGGCATCCCAGACAGGTTCAGTGGCAG TGGGTCTGGGACAGACTTCAGTCTCACCATCGACAGACTGGAGCCTGAA GATTTTGCAGTATATTACTGTCAGCAGTTTGGTAGGTCACCGGAGCTCAC TTTCGGCGGAGGGACCAAGGTGGAAATCAAA |
| 155 | 2474 | 506 | EIVLTQSPGTLSLSPGERATLSCRASQTIKNNYLAWYQQKPGQAPRLLMYG VSSRPTGIPDRFSGSGSGTDFSLTIDRLEPEDFAVYYCQQFGRSPELTFGGGT KVEIK |
| 155 | 2475 | 507 | RASQTIKNNYLA |
| 155 | 2476 | 508 | AGGGCCAGTCAGACTATTAAAAACAACTACTTAGCC |
| 155 | 2477 | 509 | GVSSRPT |
| 155 | 2478 | 510 | GGTGTATCCAGCAGGCCGACT |
| 155 | 2479 | 511 | QQFGRSPELT |
| 155 | 2480 | 512 | CAGCAGTTTGGTAGGTCACCGGAGCTCACT |
| 156 | 2481 | 513 | CAGGTGCAGCTACAGCAGTGGGGCGCAGGACTGTTGAAGCCTTCGGAGA CCCTGTCCCTCACCTGCGCTGTCTATGGTGGGTCCTTCAGTGGTTACTAC TGGGGCTGGATCCGCCAGCCCCAGGGAAGGGGCTGGAGTGGATTGGG GAAGTCAATCATAGTGGAACCTCCAATTACAACCCGTCCCTCACGAGTC GAGTCACCATATCAGTAGACCCGTCCAAGAAACAGTTGTCCCTGAAGCT GAACTCTGTGACCGCCGCGGACACGGCTGTCTATTACTGTGCGAGAGCT CCTTGGTATACTCACGCCATGGACGTCTGGGGCCAAGGGACCACGGTCA CCGTCTCCTCA |
| 156 | 2482 | 514 | QVQLQQWGAGLLKPSETLSLTCAVYGGSFSGYYWGWIRQPPGKGLEWIGE VNHSGTSNYNPSLTSRVTISVDPSKKQLSLKLNSVTAADTAVYYCARAPWY THAMDVWGQGTTVTVSS |
| 156 | 2483 | 515 | GSFSGYYWG |

TABLE 6-continued

Informal Sequence Listing

| Antibody No. | Seq. Ref. No. | SEQ ID NO. | Sequence |
|---|---|---|---|
| 156 | 2484 | 516 | GGGTCCTTCAGTGGTTACTACTGGGGC |
| 156 | 2485 | 517 | EVNHSGTSNYNPSLTS |
| 156 | 2486 | 518 | GAAGTCAATCATAGTGGAACCTCCAATTACAACCCGTCCCTCACGAGT |
| 156 | 2487 | 519 | ARAPWYTHAMDV |
| 156 | 2488 | 520 | GCGAGAGCTCCTTGGTATACTCACGCCATGGACGTC |
| 156 | 2489 | 521 | CAGTCTGTCCTGACTCAGCCTGCCTCCGTGTCTGGGTCTCCTGGACAGTC<br>GATCACCATCTCCTGCACTAGAACCAGCAGTGACGTTGGTGCTTATAGTT<br>ATGTCTCCTGGTACCAACAACACCCAGGCAAAGCCCCCAAACTCATGAT<br>TTATGATGTCAATAATCGGCCCTCAGGGGTTTCTAATCGCTTCTCTGGCT<br>CCAAGTCTGGCAACACGGCCTCCCTGACCATCTCTGGGCTCCAGGCTGA<br>GGACGAGGCTGATTATTACTGCAGCTCATATACAAACAGCAACACTCTC<br>GGGGTGTTCGGCGGAGGGACCAAGCTGACCGTCCTA |
| 156 | 2490 | 522 | QSVLTQPASVSGSPGQSITISCTRTSSDVGAYSYVSWYQQHPGKAPKLMIYD<br>VNNRPSGVSNRFSGSKSGNTASLTISGLQAEDEADYYCSSYTNSNTLGVFGG<br>GTKLTVL |
| 156 | 2491 | 523 | TRTSSDVGAYSYVS |
| 156 | 2492 | 524 | ACTAGAACCAGCAGTGACGTTGGTGCTTATAGTTATGTCTCC |
| 156 | 2493 | 525 | DVNNRPS |
| 156 | 2494 | 526 | GATGTCAATAATCGGCCCTCA |
| 156 | 2495 | 527 | SSYTNSNTLGV |
| 156 | 2496 | 528 | AGCTCATATACAAACAGCAACACTCTCGGGGTG |
| 157 | 2497 | 529 | GAGGTGCAGCTGTTGGAGTCTGGGGGACTCGTGGTACAGCCTGGGGGGT<br>CCCTGAGACTGTCCTGTGCAGCCTCTGGATTCATCTTTGATGATTATACC<br>ATGCACTGGGTCCGTCAAGCTCCGGGGAAGGGTCTGGAGTGGATCTCTC<br>TTATTAGTTGGGATAGTCTTGACACATACTATGCAGGCTCTGTGCAGGGC<br>CGCTTCACCATCTCCAGAGACAACAGCAGAAACTCCCTCTATCTGCGAA<br>TGAACAGTCTGAGACCTGAGGACACCGCCTTGTATTACTGTGCAAAAAC<br>AAAGTATAGGGGTACTTATTACTACTTTGACTCGTGGGGCCAGGGAACC<br>CTGGTCACCGTCTCCTCA |
| 157 | 2498 | 530 | EVQLLESGGLVVQPGGSLRLSCAASGFIFDDYTMHWVRQAPGKGLEWISLIS<br>WDSLDTYYAGSVQGRFTISRDNSRNSLYLRMNSLRPEDTALYYCAKTKYR<br>GTYYYFDSWGQGTLVTVSS |
| 157 | 2499 | 531 | FIFDDYTMH |
| 157 | 2500 | 532 | TTCATCTTTGATGATTATACCATGCAC |
| 157 | 2501 | 533 | LISWDSLDTYYAGSVQG |
| 157 | 2502 | 534 | CTTATTAGTTGGGATAGTCTTGACACATACTATGCAGGCTCTGTGCAGGG<br>C |
| 157 | 2503 | 535 | AKTKYRGTYYYFDS |
| 157 | 2504 | 536 | GCAAAAACAAAGTATAGGGGTACTTATTACTACTTTGACTCG |
| 157 | 2505 | 537 | GACATCCGGGTGACCCAGTCTCCATCCTCCCTGTCTGCATCTGTAGGAGA<br>CAGAGTCACCATCACTTGCCAGGCGAGTCAGGACATTAGCAACTATTTA<br>AATTGGTATCAGCAGAAACCAGGGAAAGCCCCTAAGCTCCTGATCTACG<br>ATGCATCCAATTTGGAAACAGGGGTCCCATCAAGGTTCAGTGGACGTGG<br>ATCTGGGACAGATTTTACTTTCACCATCAGCAGCCTGCAGCCTGAAGATA<br>TTGCAACATATTACTGTCAACAATATGATAATCTCCCTCCGGTCACTTTC<br>GGCCCTGGGACCAAGGTGGAAATCAAA |
| 157 | 2506 | 538 | DIRVTQSPSSLSASVGDRVTITCQASQDISNYLNWYQQKPGKAPKLLIYDAS<br>NLETGVPSRFSGRGSGTDFTFTISSLQPEDIATYYCQQYDNLPPVTFGPGTKV<br>EIK |
| 157 | 2507 | 539 | QASQDISNYLN |

TABLE 6-continued

Informal Sequence Listing

| Antibody No. | Seq. Ref. No. | SEQ ID NO. | Sequence |
|---|---|---|---|
| 157 | 2508 | 540 | CAGGCGAGTCAGGACATTAGCAACTATTTAAAT |
| 157 | 2509 | 541 | DASNLET |
| 157 | 2510 | 542 | GATGCATCCAATTTGGAAACA |
| 157 | 2511 | 543 | QQYDNLPPVT |
| 157 | 2512 | 544 | CAACAATATGATAATCTCCCTCCGGTCACT |
| 158 | 2513 | 545 | GAGGTGCAGCTGTTGGAGTCTGGGGGAGGCCTGGTCAAGCCGGGGGGGT<br>CCCTGAGACTCTCCTGTGCAGCCTCTGGATTCACCTTCAGTAGTTATGGC<br>ATGCACTGGGTCCGCCAGGCGCAGGGAAGGGGCTAGAGTGGGTCTCAT<br>CCATTACTGCTGGTAGTAGTTACATGGACTACGCAGACTCAGTGAAGGG<br>CCGATTCACCGTCTCCAGAGACAACGGCAAGAACTCACTGTACCTGCAA<br>ATGAACAGCCTGAGAGCCGAGGACACGGCTGTCTACTTCTGTGCGAGAG<br>AGGACTATGATAGTCGTGTTTATTACCTTAAGTGGTTCGACCCCTGGGGC<br>CAGGGAACCCTGGTCACCGTCTCCTCA |
| 158 | 2514 | 546 | EVQLLESGGGLVKPGGSLRLSCAASGFTFSSYGMHWVRQAPGKGLEWVSSI<br>TAGSSYMDYADSVKGRFTVSRDNGKNSLYLQMNSLRAEDTAVYFCAREDY<br>DSRVYYLKWFDPWGQGTLVTVSS |
| 158 | 2515 | 547 | FTFSSYGMH |
| 158 | 2516 | 548 | TTCACCTTCAGTAGTTATGGCATGCAC |
| 158 | 2517 | 549 | SITAGSSYMDYADSVKG |
| 158 | 2518 | 550 | TCCATTACTGCTGGTAGTAGTTACATGGACTACGCAGACTCAGTGAAGG<br>GC |
| 158 | 2519 | 551 | AREDYDSRVYYLKWFDP |
| 158 | 2520 | 552 | GCGAGAGAGGACTATGATAGTCGTGTTTATTACCTTAAGTGGTTCGACCC<br>C |
| 158 | 2521 | 553 | CAGTCTGTCTTGACGCAGCCGCCCTCAGTGTCTGGGGCCCCAGGGCAGA<br>GAGTCACCATCTCCTGCACTGGGAGCAGCTCCAACATCGGGACAGGTTA<br>TGATGTACACTGGTACCAGCAGCTTCCAGGATCAGCCCCCAAACTCCTC<br>ATCTATGGTAACAGCAATCGGCCCTCAGGGGTCCCTGACCGATTCTCTGG<br>GTCCAAGTCTGGCACCTCAGCCTCCCTGGCCATCACTGGGCTCCAGGCTG<br>AGGATGAGGCTGACTATTATTGCCAGTCCTATGACAGCAGTCGGAGTGG<br>TTATGTCTTCGGAACTGGGACCAAGCTGACCGTCCTA |
| 158 | 2522 | 554 | QSVLTQPPSVSGAPGQRVTISCTGSSSNIGTGYDVHWYQQLPGSAPKLLIYG<br>NSNRPSGVPDRFSGSKSGTSASLAITGLQAEDEADYYCQSYDSSRSGYVFGT<br>GTKLTVL |
| 158 | 2523 | 555 | TGSSSNIGTGYDVH |
| 158 | 2524 | 556 | ACTGGGAGCAGCTCCAACATCGGGACAGGTTATGATGTACAC |
| 158 | 2525 | 557 | GNSNRPS |
| 158 | 2526 | 558 | GGTAACAGCAATCGGCCCTCA |
| 158 | 2527 | 559 | QSYDSSRSGYV |
| 158 | 2528 | 560 | CAGTCCTATGACAGCAGTCGGAGTGGTTATGTC |
| 159 | 2529 | 561 | GAGGTGCAGCTGGTGGAGTCTGGGGGCGCCTTGGTAAAGCCGGGGGGGT<br>CCCTTAGACTCTCCTGTGTAGGCACTGGACTCACTTTCACTACTGCCTAC<br>ATGAGCTGGGCCCGCCAGGCTCCAGGGAAGGGGCTGGAGTGGGTTGGTC<br>GCATTAAGAGCAAAAGTGATGGTGGGACAACAGAGTACCCTACACCCGT<br>CAAAGGCAGATTCACCATCTCAAGAGATGAATCCAAAAACACCCTGTAT<br>CTGCAAATGAACAGCCTGAAAATCGAGGACACAGCCGTCTATTATTGTA<br>CCACAGATAGGGGGATAACAGCTCGTCCTATCTTCGACTCCTGGGGCCA<br>GGGAACCCTGGTCACCGTCTCCTCA |
| 159 | 2530 | 562 | EVQLVESGGALVKPGGSLRLSCVGTGLTFTTAYMSWARQAPGKGLEWVGR<br>IKSKSDGGTTEYPTPVKGRFTISRDESKNTLYLQMNSLKIEDTAVYYCTTDR<br>GITARPIFDSWGQGTLVTVSS |

TABLE 6-continued

Informal Sequence Listing

| Antibody No. | Seq. Ref. No. | SEQ ID NO. | Sequence |
|---|---|---|---|
| 159 | 2531 | 563 | LTFTTAYMS |
| 159 | 2532 | 564 | CTCACTTTCACTACTGCCTACATGAGC |
| 159 | 2533 | 565 | RIKSKSDGGTTEYPTPVKG |
| 159 | 2534 | 566 | CGCATTAAGAGCAAAAGTGATGGTGGGACAACAGAGTACCCTACACCCG<br>TCAAAGGC |
| 159 | 2535 | 567 | TTDRGITARPIFDS |
| 159 | 2536 | 568 | ACCACAGATAGGGGGATAACAGCTCGTCCTATCTTCGACTCC |
| 159 | 2537 | 569 | CAGTCTGTCTTGACGCAGCCGCCCTCAGTGTCTGGGGCCCTAGGGCGGA<br>GGGTCACCATCTCCTGCACTGGGAGCAGCTCCAACATCGGGGCAGGTTA<br>TGATGTACATTGGTACAGGCAACTTCCAGGAACAGCCCCCAAACTCCTC<br>ATTTATGGTAACACCAAACGGCCCTCAGGGGTCCCTGACCGATTCTCTGG<br>CTCCAAGTATGCCACCTCAGCCTCCCTGGCCATCACTGGGCTCCAGGCTG<br>AGGATGACGCTGATTATTACTGCCAGTCCTATGACGGCGGCCTGAGTGG<br>TTATGTCTTCGGAACTGGCACCCAGCTGACCGTCCTC |
| 159 | 2538 | 570 | QSVLTQPPSVSGALGRRVTISCTGSSSNIGAGYDVHWYRQLPGTAPKLLIYG<br>NTKRPSGVPDRFSGSKYATSASLAITGLQAEDDADYYCQSYDGGLSGYVFG<br>TGTQLTVL |
| 159 | 2539 | 571 | TGSSSNIGAGYDVH |
| 159 | 2540 | 572 | ACTGGGAGCAGCTCCAACATCGGGGCAGGTTATGATGTACAT |
| 159 | 2541 | 573 | GNTKRPS |
| 159 | 2542 | 574 | GGTAACACCAAACGGCCCTCA |
| 159 | 2543 | 575 | QSYDGGLSGYV |
| 159 | 2544 | 576 | CAGTCCTATGACGGCGGCCTGAGTGGTTATGTC |
| 160 | 2545 | 577 | CAGGTCCAGCTTGTGCAGTCTGGGGGAGGCCTGGTCAGGCCTGGGGGGT<br>CCCTGAGACTCTCCTGTGCAGCCTCTGGATTCATGTTCAGTACCTACAGC<br>ATGAACTGGCTCCGCACGGTCCCAGGGAAGGGGCTGGAGTGGGTCTCAT<br>CCATTAGTGGTAGTAGCAGTCACATATACTACGCAGACTCAGTGAAGGG<br>CCGATTCACCATCTCCAGAGACAACACCAAGAACTCACTGTATCTGCAA<br>ATGAACAGCCTGAGACCCGAAGACACGGCTTTATATTACTGTGCGAGAT<br>ATTTTGGTGACTACTCAGGGTTGGGGAACTACTACTACTACGGTATGGAC<br>GTCTGGGGCCAGGGGACCACGGTCACCGTCTCCTCA |
| 160 | 2546 | 578 | QVQLVQSGGGLVRPGGSLRLSCAASGFMFSTYSMNWLRTVPGKGLEWVSS<br>ISGSSSHIYYADSVKGRFTISRDNTKNSLYLQMNSLRPEDTALYYCARYFGD<br>YSGLGNYYYYGMDVWGQGTTVTVSS |
| 160 | 2547 | 579 | FMFSTYSMN |
| 160 | 2548 | 580 | TTCATGTTCAGTACCTACAGCATGAAC |
| 160 | 2549 | 581 | SISGSSSHIYYADSVKG |
| 160 | 2550 | 582 | TCCATTAGTGGTAGTAGCAGTCACATATACTACGCAGACTCAGTGAAGG<br>GC |
| 160 | 2551 | 583 | ARYFGDYSGLGNYYYYGMDV |
| 160 | 2552 | 584 | GCGAGATATTTTGGTGACTACTCAGGGTTGGGGAACTACTACTACTACG<br>GTATGGACGTC |
| 160 | 2553 | 585 | GATATTGTGATGACGCAGTCTCCAGTCTCCCTGCCCGTCACCCCTGGAGA<br>GCCGGCCTCCATCTCCTGCAGGTCTAGTCAGAGCCTCCTGCATTCTAATG<br>GAAACAACTATTTGGATTGGTACCTGCAGAGGCCAGGGCAGTCTCCACA<br>GCTCCTCATCTATTTGGGTTCTAATCGGGCCTCCGGGGTCCCTGACAGGT<br>TCAGTGGCAGTGGATCAGGCACAGATTTTACACTGAGAATCAGCAGAGT<br>GGAGGCTGAGGATGTTGGGGTTTATTACTGCATGCAAGCTCTACAAACT<br>CCTCGCTTCGGCGGAGGGACCAAGGTGGAAATCAAA |

TABLE 6-continued

Informal Sequence Listing

| Antibody No. | Seq. Ref. No. | SEQ ID NO. | Sequence |
|---|---|---|---|
| 160 | 2554 | 586 | DIVMTQSPVSLPVTPGEPASISCRSSQSLLHSNGNNYLDWYLQRPGQSPQLLI<br>YLGSNRASGVPDRFSGSGSGTDFTLRISRVEAEDVGVYYCMQALQTPRFGG<br>GTKVEIK |
| 160 | 2555 | 587 | RSSQSLLHSNGNNYLD |
| 160 | 2556 | 588 | AGGTCTAGTCAGAGCCTCCTGCATTCTAATGGAAACAACTATTTGGAT |
| 160 | 2557 | 589 | LGSNRAS |
| 160 | 2558 | 590 | TTGGGTTCTAATCGGGCCTCC |
| 160 | 2559 | 591 | MQALQTPR |
| 160 | 2560 | 592 | ATGCAAGCTCTACAAACTCCTCGC |
| 161 | 2561 | 593 | GAGGTGCAGCTGGTGGAGTCTGGGGGACACTTGGTACAGCCTGGGGGGT<br>CCCTGAGACTCTCCTGTGCAGCCTCTGGATTCACCTTCAGTAGCTATAGT<br>ATGAACTGGGTCCGCCAGGCTCCAGGGAAGGGGCTGGAGTGGATTTCAT<br>ACATTAGTAGTAGTAGTAGTACCATGTACTACGCAGACTCTGTGAAGGG<br>CCGATTCACCATGTCCAGAGACAATGCCAAGAACTCACTGTATCTGCAA<br>ATGAACAGCCTGAGAGACGAGGACACGGCTTTGTATTACTGTGCGAGAG<br>ATTTCCCCCCTATTAATCTAGCAGCGACAACCCGAAACTACTACTACTAT<br>GTTATGGACGTCTGGGGCCAAGGGACCACGGTCACCGTCTCCTCA |
| 161 | 2562 | 594 | EVQLVESGGHLVQPGGSLRLSCAASGFTFSSYSMNWVRQAPGKGLEWISYI<br>SSSSSTMYYADSVKGRFTMSRDNAKNSLYLQMNSLRDEDTALYYCARDFP<br>PINLAATTRNYYYYVMDVWGQGTTVTVSS |
| 161 | 2563 | 595 | FTFSSYSMN |
| 161 | 2564 | 596 | TTCACCTTCAGTAGCTATAGTATGAAC |
| 161 | 2565 | 597 | YISSSSSTMYYADSVKG |
| 161 | 2566 | 598 | TACATTAGTAGTAGTAGTAGTACCATGTACTACGCAGACTCTGTGAAGG<br>GC |
| 161 | 2567 | 599 | ARDFPPINLAATTRNYYYYVMDV |
| 161 | 2568 | 600 | GCGAGAGATTTCCCCCCTATTAATCTAGCAGCGACAACCCGAAACTACT<br>ACTACTATGTTATGGACGTC |
| 161 | 2569 | 601 | GACATCCAGTTGACCCAGTCTCCATCCTCCCTGTCTGCATCTGTAGGAGA<br>CAGAGTCACCATCACTTGCCGGGCAAGTCAGAGCATTAGCAGCTATTTA<br>AATTGGTATCAGCAGAAACCAGGGAAAGCCCCTAACCTCCTAATCTATG<br>CTACATCCAATTTGAAAAGTGGGGTCCCATCAAGGTTCAGTGGCAGTGG<br>ATCTGGGACAGATTTCACTCTCACCATCAGCAGTCTGCAACCTGAAGATT<br>TTGCAACTTACTACTGTCAACAGAGTTACAGTACCTCGTACACTTTTGGC<br>CAGGGGACCAAAGTGGATATCAAA |
| 161 | 2570 | 602 | DIQLTQSPSSLSASVGDRVTITCRASQSISSYLNWYQQKPGKAPNLLIYATSN<br>LKSGVPSRFSGSGSGTDFTLTISSLQPEDFATYYCQQSYSTSYTFGQGTKVDI<br>K |
| 161 | 2571 | 603 | RASQSISSYLN |
| 161 | 2572 | 604 | CGGGCAAGTCAGAGCATTAGCAGCTATTTAAAT |
| 161 | 2573 | 605 | ATSNLKS |
| 161 | 2574 | 606 | GCTACATCCAATTTGAAAAGT |
| 161 | 2575 | 607 | QQSYSTSYT |
| 161 | 2576 | 608 | CAACAGAGTTACAGTACCTCGTACACT |
| 162 | 2577 | 609 | GAGGTGCAGCTGGTGGAGTCCGGCCCTACTCTGGTGAAACCCACACAGA<br>CCCTCACGCTGACCTGCACCTTCTCTGGGTTCTCACTCACCACTATTGGA<br>GTGGGTGTGGGCTGGATCCGTCAGCCCCCAGGAAAGGCCCTGGAGTTTC<br>TTGGAATCGTTTATTGGGATGATGATAAGCGGTACAGCCCATCTCTGAA<br>GAGCAGGCTCACCATCACCAAGGACACCTCCAAAAACCAGGTGGTCCTT<br>ACGATGACCACGTTGGCCCCTGAGGACACAGGCACATATTACTGTACAT |

TABLE 6-continued

Informal Sequence Listing

| Antibody No. | Seq. Ref. No. | SEQ ID NO. | Sequence |
|---|---|---|---|
| | | | ACGCCCGCTATAGCAGTGCCTTGTTCGGGGGTTACTACTTTCACTCGTGG GGCCAGGGAACCCTGGTCACCGTCTCCTCA |
| 162 | 2578 | 610 | EVQLVESGPTLVKPTQTLTLTCTFSGFSLTTIGVGVGWIRQPPGKALEFLGIV YWDDDKRYSPSLKSRLTITKDTSKNQVVLTMTTLAPEDTGTYYCTYARYSS ALFGGYYFHSWGQGTLVTVSS |
| 162 | 2579 | 611 | FSLTTIGVGVG |
| 162 | 2580 | 612 | TTCTCACTCACCACTATTGGAGTGGGTGTGGGC |
| 162 | 2581 | 613 | IVYWDDDKRYSPSLKS |
| 162 | 2582 | 614 | ATCGTTTATTGGGATGATGATAAGCGGTACAGCCCATCTCTGAAGAGC |
| 162 | 2583 | 615 | TYARYSSALFGGYYFHS |
| 162 | 2584 | 616 | ACATACGCCCGCTATAGCAGTGCCTTGTTCGGGGGTTACTACTTTCACTC G |
| 162 | 2585 | 617 | CAGTCTGTCCTGACGCAGCCGCCCTCGGTGTCAGTGGCCCAGGACAGA CGGCCAAGATTACCTGTGGGGGAAACGACATTGGAAGTAGAAGTGTGCA CTGGTACCAGCAGAAGCCAGGCCAGGCCCCTGTGCTGGTCGTCTATGAT AATAGCGACCGGCCCTCAGGATCCCTGAACGATTCTCTGGCTCCAATTC TGGAGACACGGCCACCCTGACCATCAGCAGGGTCGAAGCCGGGGATGA GGCCGTCTATTACTGTCAGGTGTGGGAGAGTAGTGGTGATCATCCGAGG ATATTCGGCGGAGGGACCAAGCTCACCGTCCTA |
| 162 | 2586 | 618 | QSVLTQPPSVSVAPGQTAKITCGGNDIGSRSVHWYQQKPGQAPVLVVYDNS DRPSGIPERFSGSNSGDTATLTISRVEAGDEAVYYCQVWESSGDHPRIFGGG TKLTVL |
| 162 | 2587 | 619 | GGNDIGSRSVH |
| 162 | 2588 | 620 | GGGGGAAACGACATTGGAAGTAGAAGTGTGCAC |
| 162 | 2589 | 621 | DNSDRPS |
| 162 | 2590 | 622 | GATAATAGCGACCGGCCCTCA |
| 162 | 2591 | 623 | QVWESSGDHPRI |
| 162 | 2592 | 624 | CAGGTGTGGGAGAGTAGTGGTGATCATCCGAGGATA |
| 163 | 2593 | 625 | GAGGTGCAGCTGGTGGAGTCTGGGGGCGCCCTGGTAAAGCCGGGGGGG TCCCTTAGACTCTCCTGTGTAGGCACTGGACTCACTTTCACTACTGCCTA CATGAGCTGGGCCCGCCAGGCTCCAGGGAAGGGGCTGGAGTGGGTTGGT CGTATTCTGAGCAAAAGTGATGGTGGGACAACAGACTACCCTACACCCG TCAAAGGCAGATTCACCATCTCAAGAGATGAATCTAAAAACACCCTGTA TCTGCAAATGAACAGCCTGAAAATCGAGGACACAGCCGTCTATTATTGT ACCACAGATAGGGGGATAACAGCTCGTCCTATCTTCGACTCCTGGGGCC AGGGAACCCTGGTCACCGTCTCCTCA |
| 163 | 2594 | 626 | EVQLVESGGALVKPGGSLRLSCVGTGLTFTTAYMSWARQAPGKGLEWVGR ILSKSDGGTTDYPTPVKGRFTISRDESKNTLYLQMNSLKIEDTAVYYCTTDR GITARPIFDSWGQGTLVTVSS |
| 163 | 2595 | 627 | LTFTTAYMS |
| 163 | 2596 | 628 | CTCACTTTCACTACTGCCTACATGAGC |
| 163 | 2597 | 629 | RILSKSDGGTTDYPTPVKG |
| 163 | 2598 | 630 | CGTATTCTGAGCAAAAGTGATGGTGGGACAACAGACTACCCTACACCCG TCAAAGGC |
| 163 | 2599 | 631 | TTDRGITARPIFDS |
| 163 | 2600 | 632 | ACCACAGATAGGGGGATAACAGCTCGTCCTATCTTCGACTCC |
| 163 | 2601 | 633 | CAGTCTGTGCTGACGCAGCCGCCCTCAGTGTCTGGGGCCCAGGGCGGA GGGTCACCATCTCCTGCACTGGGAGCAGCTCCAACATCGGGGCAGGTTA TGATGTACATTGGTACAGGCAACTTCCAGGAACAGCCCCCAAACTCCTC ATTTATGGTAACACCAAACGGCCCTCAGGGGTCCCTGACCGATTCTCTGG |

TABLE 6-continued

Informal Sequence Listing

| Antibody No. | Seq. Ref. No. | SEQ ID NO. | Sequence |
|---|---|---|---|
| | | | CTCCAAGTATGCCACCTCAGCCTCCCTGGCCATCACTGGGCTCCAGGCTG ACGATGACGCTGATTATTACTGCCAGTCCTATGACGGCGGCCTGAGTGG TTATGTCTTCGGAACTGGGACCAAGGTCACCGTCCTA |
| 163 | 2602 | 634 | QSVLTQPPSVSGALGRRVTISCTGSSSNIGAGYDVHWYRQLPGTAPKLLIYG NTKRPSGVPDRFSGSKYATSASLAITGLQADDDADYYCQSYDGGLSGYVFG TGTKVTVL |
| 163 | 2603 | 635 | TGSSSNIGAGYDVH |
| 163 | 2604 | 636 | ACTGGGAGCAGCTCCAACATCGGGGCAGGTTATGATGTACAT |
| 163 | 2605 | 637 | GNTKRPS |
| 163 | 2606 | 638 | GGTAACACCAAACGGCCCTCA |
| 163 | 2607 | 639 | QSYDGGLSGYV |
| 163 | 2608 | 640 | CAGTCCTATGACGGCGGCCTGAGTGGTTATGTC |
| 164 | 2609 | 641 | CAGGTCCAGCTGGTGCAGTCTGGGGGAGGCCTGGTCAAGCCTGGGGGGT CCCTGAGACTCTCCTGTGCAGGCTCTGGATTCACCTTCAGTAGCTATACC CTGAACTGGGTCCGCCAGGCTCCAGGGAAGGGGCTGGAGTGGGTCTCAT CCATTAGTAGTAGTAGTACTTACATATACTACGCAGACTCAGTGAAGGG CCGATTCACCATCTCCAGAGACAACGCCAAGAACTCACTGCATCTGCAA ATGAACAGCCTGAGAGCCGAGGACACGGCTGTGTATTATTGTGCGAGAG CTGACTATGATAGAAGTGTTTATCACCTCAATTGGTTCGACCCCTGGGGC CAGGGAACCCTGGTCACCGTCTCCTCA |
| 164 | 2610 | 642 | QVQLVQSGGGLVKPGGSLRLSCAGSGFTFSSYTLNWVRQAPGKGLEWVSSI SSSSTYIYYADSVKGRFTISRDNAKNSLHLQMNSLRAEDTAVYYCARADYD RSVYHLNWFDPWGQGTLVTVSS |
| 164 | 2611 | 643 | FTFSSYTLN |
| 164 | 2612 | 644 | TTCACCTTCAGTAGCTATACCCTGAAC |
| 164 | 2613 | 645 | SISSSSTYIYYADSVKG |
| 164 | 2614 | 646 | TCCATTAGTAGTAGTAGTACTTACATATACTACGCAGACTCAGTGAAGG GC |
| 164 | 2615 | 647 | ARADYDRSVYHLNWFDP |
| 164 | 2616 | 648 | GCGAGAGCTGACTATGATAGAAGTGTTTATCACCTCAATTGGTTCGACCC C |
| 164 | 2617 | 649 | CAGTCTGTGTTGACGCAGCCGCCCTCAGTGTCTGGGGCCCCAGGGCAGA GGGTCACCATCTCCTGCACTGGGAGCAGCTCCAACATCGGGGCAGGTTA TGATGTACACTGGTACCAGCAACTTCCAGGAGCAGCCCCCAAACTCCTC ATCTATGGTAACACCAATCGGCCCTCAGGGGTCCCTGACCGATTTTCTGG CTCCAAGTCTGGCACCTCAGCCTCCCTGGCCATCACTGGGCTCCAGGCTG ACGATGAGGCTGATTATTACTGCCAGTCCTATGACAGCAGCCTGAGTGG CACTTGGGTGTTCGGCGAGGGACCAAGCTCACCGTCCTA |
| 164 | 2618 | 650 | QSVLTQPPSVSGAPGQRVTISCTGSSSNIGAGYDVHWYQQLPGAAPKLLIYG NTNRPSGVPDRFSGSKSGTSASLAITGLQADDEADYYCQSYDSSLSGTWVF GGGTKLTVL |
| 164 | 2619 | 651 | TGSSSNIGAGYDVH |
| 164 | 2620 | 652 | ACTGGGAGCAGCTCCAACATCGGGGCAGGTTATGATGTACAC |
| 164 | 2621 | 653 | GNTNRPS |
| 164 | 2622 | 654 | GGTAACACCAATCGGCCCTCA |
| 164 | 2623 | 655 | QSYDSSLSGTWV |
| 164 | 2624 | 656 | CAGTCCTATGACAGCAGCCTGAGTGGCACTTGGGTG |
| 165 | 2625 | 657 | GAGGTGCAGCTGTTGGAGTCTGGGGGAGGCTTGGTACAGCCAGGGCGGT CCCTGAGACTCTCTTGTTCAGGTTCTGGATTCACCTTTGGGGATTATGCT CTGAGCTGGGTCCGCCAGGCTCCAGGGAAGGGGCTGGAGTGGGTAGGTT |

TABLE 6-continued

Informal Sequence Listing

| Antibody No. | Seq. Ref. No. | SEQ ID NO. | Sequence |
|---|---|---|---|
| | | | TCATTAGAAGCAAAGCCTATGGTGGGACAACAGAATACGCCGCGTCTGT<br>GAAAGGCAGATTCACCATCTCAAGAGATGATTCCAAAAGCATCGCCTAT<br>CTGCAAATGAACAGCCTGAAAACCGAGGACACAGCCGTGTATTACTGTA<br>CTATGGCTGTAGTGGTGCCAGGTGCTACAGATGCTTTTGATATCTGGGGC<br>CAAGGGACAATGGTCACCGTCTCTTCA |
| 165 | 2626 | 658 | EVQLLESGGGLVQPGRSLRLSCSGSGFTFGDYALSWVRQAPGKGLEWVGFI<br>RSKAYGGTTEYAASVKGRFTISRDDSKSIAYLQMNSLKTEDTAVYYCTMAV<br>VVPGATDAFDIWGQGTMVTVSS |
| 165 | 2627 | 659 | FTFGDYALS |
| 165 | 2628 | 660 | TTCACCTTTGGGGATTATGCTCTGAGC |
| 165 | 2629 | 661 | FIRSKAYGGTTEYAASVKG |
| 165 | 2630 | 662 | TTCATTAGAAGCAAAGCCTATGGTGGGACAACAGAATACGCCGCGTCTG<br>TGAAAGGC |
| 165 | 2631 | 663 | TMAVVVPGATDAFDI |
| 165 | 2632 | 664 | ACTATGGCTGTAGTGGTGCCAGGTGCTACAGATGCTTTTGATATC |
| 165 | 2633 | 665 | AATTTTATGCTGACTCAGCCCCACTCTGTGTCGGAGTCTCCGGGGAAGAC<br>GGTAACCATCTCCTGTACCCGCAGCAGTGGCAGCATTGCCAGCGACTAT<br>GTGCAGTGGTTCCAGCAGCGCCCGGGCAGTTCCCCCGCCACTGTGATCT<br>ATCAGGATAACCAAAGACCCTCTGGGGTCCCTGATCGGTTCTCTGGCTCC<br>ATCGACACCTCCTCCAACTCTGCCTCCCTCACCATCTCTGGACTGAAGAC<br>TGAGGACGAGGCTGACTACTACTGTCACTCTTATGATAGTAGCAATCCTT<br>GGGTGTTCGGCGGAGGGACCAAGCTCACCGTCCTA |
| 165 | 2634 | 666 | NFMLTQPHSVSESPGKTVTISCTRSSGSIASDYVQWFQQRPGSSPATVIYQDN<br>QRPSGVPDRFSGSIDTSSNSASLTISGLKTEDEADYYCHSYDSSNPWVFGGG<br>TKLTVL |
| 165 | 2635 | 667 | TRSSGSIASDYVQ |
| 165 | 2636 | 668 | ACCCGCAGCAGTGGCAGCATTGCCAGCGACTATGTGCAG |
| 165 | 2637 | 669 | QDNQRPS |
| 165 | 2638 | 670 | CAGGATAACCAAAGACCCTCT |
| 165 | 2639 | 671 | HSYDSSNPWV |
| 165 | 2640 | 672 | CACTCTTATGATAGTAGCAATCCTTGGGTG |
| 166 | 2641 | 673 | GAGGTGCAGCTGGTGGAGTCCGGAGGAGGCTTGATCCAGCCGGGGGGG<br>TCCCTGAGACTCTCCTGTGCAGTCTCTGGGTTCAGCGTCAGCAGCAACTA<br>TATAAGTTGGGTCCGCCAGCCTCCAGGGAAGGGGCTGGAGTGGGTCTCA<br>GTTAGTTATAGTAGTGGTGTCACAGACTACGCAGACTCCGTGAAGGGCC<br>GATTCACCACCTCCAGAGACAACTCCAAGAACACGCTGTATCTTCAAAT<br>GAACAGCCTGAGAGGCGAAGACACGGCCGTCTATTACTGTGCGAGAGA<br>GTTGGTGCCAAATTTCTATGAAAGTCATGGTTATTTTTCCGTGTGGGGCC<br>AGGGAACCCTGGTCACCGTCTCCTCA |
| 166 | 2642 | 674 | EVQLVESGGGLIQPGGSLRLSCAVSGFSVSSNYISWVRQPPGKGLEWVSVSY<br>SSGVTDYADSVKGRFTTSRDNSKNTLYLQMNSLRGEDTAVYYCARELVPN<br>FYESHGYFSVWGQGTLVTVSS |
| 166 | 2643 | 675 | FSVSSNYIS |
| 166 | 2644 | 676 | TTCAGCGTCAGCAGCAACTATATAAGT |
| 166 | 2645 | 677 | VSYSSGVTDYADSVKG |
| 166 | 2646 | 678 | GTTAGTTATAGTAGTGGTGTCACAGACTACGCAGACTCCGTGAAGGGC |
| 166 | 2647 | 679 | ARELVPNFYESHGYFSV |
| 166 | 2648 | 680 | GCGAGAGAGTTGGTGCCAAATTTCTATGAAAGTCATGGTTATTTTTCCGT<br>G |

TABLE 6-continued

Informal Sequence Listing

| Antibody No. | Seq. Ref. No. | SEQ ID NO. | Sequence |
|---|---|---|---|
| 166 | 2649 | 681 | GATATTGTGATGACTCAGTCTCCAGGCACCCTGTCTTTGTCTCCAGGGGA<br>AAGAGCCACCCTCTCCTGCAGGGCCAGTCAGAGAGTTGACAGCAGCTAC<br>TTAGCCTGGTACCAGCAGAAACCTGGCCAGGCTCCCAGGCTCCTCATCT<br>ATGGTGGATCCAGCAGGGCCACTGGCATCCCAGACAGGTTCAGTGGCAG<br>TGGGTCTGGGACAGACTTCACTCTCACCATCAGCAGGCTGGAGCCTGAA<br>GATTTTGCGTTGTATTACTGTCAGCAGTATGGTTTCTCACAGACGTTCGG<br>CCAAGGGACCAAGGTGGAGATCAAA |
| 166 | 2650 | 682 | DIVMTQSPGTLSLSPGERATLSCRASQRVDSSYLAWYQQKPGQAPRLLIYGG<br>SSRATGIPDRFSGSGSGTDFTLTISRLEPEDFALYYCQQYGFSQTFGQGTKVEI<br>K |
| 166 | 2651 | 683 | RASQRVDSSYLA |
| 166 | 2652 | 684 | AGGGCCAGTCAGAGAGTTGACAGCAGCTACTTAGCC |
| 166 | 2653 | 685 | GGSSRAT |
| 166 | 2654 | 686 | GGTGGATCCAGCAGGGCCACT |
| 166 | 2655 | 687 | QQYGFSQT |
| 166 | 2656 | 688 | CAGCAGTATGGTTTCTCACAGACG |
| 167 | 2657 | 689 | GAGGTGCAGCTGTTGGAGACTGGGGGAGGCTTGGTTAAGCCGGGGGGGT<br>CCCTGAGACTCTCCTGTGAAGCCACTGGATTCACTTTCAGCGACTTTGCC<br>ATGAGCTGGGTCCGCCAGGCTCCAGGGAAGGGGCTGGAGTGGGTCTCAC<br>TGATTAAAAGTAGTGATTATCCATACTATGCAGACTCCGTGAGGGGCCG<br>CTTCACCATCTCCAGAGACAATTCCAAGAACACCCTGTATCTGCGAATG<br>GACAACCTGAGAGCCGACGACACGGCCGTGTATTACTGTGCCAAGGACG<br>CCGATTTTTGGAGTGGTGAGGCCTACAATGGAGGGTACAACTTTGACTC<br>CTGGGGCCAGGGAACCCTGGTCACCGTCTCCTCA |
| 167 | 2658 | 690 | EVQLLETGGGLVKPGGSLRLSCEATGFTFSDFAMSWVRQAPGKGLEWVSLI<br>KSSDYPYYADSVRGRFTISRDNSKNTLYLRMDNLRADDTAVYYCAKDADF<br>WSGEAYNGGYNFDSWGQGTLVTVSS |
| 167 | 2659 | 691 | FTFSDFAMS |
| 167 | 2660 | 692 | TTCACTTTCAGCGACTTTGCCATGAGC |
| 167 | 2661 | 693 | LIKSSDYPYYADSVRG |
| 167 | 2662 | 694 | CTGATTAAAAGTAGTGATTATCCATACTATGCAGACTCCGTGAGGGGC |
| 167 | 2663 | 695 | AKDADFWSGEAYNGGYNFDS |
| 167 | 2664 | 696 | GCCAAGGACGCCGATTTTTGGAGTGGTGAGGCCTACAATGGAGGGTACA<br>ACTTTGACTCC |
| 167 | 2665 | 697 | GAAATTGTATTGACACAGTCTCCAGCCACCCTGTCTGTCTCTCCAGGGGA<br>AAGAGCCACCCTCTCCTGCAGGGCCAGTCAGAGTATTGGCACCAACTTG<br>GCCTGGTACCAGCAAAAACCTGGCCAGGCTCCCCGGCTCCTCATCTTTGG<br>TGCCTCAACCAGGGCCACGGGTATCCCAGCCAGGTTCACTGGCAGTGGG<br>TCTGGGACAGAGTTCACTCTCACCATCGGCAGCCTCCAGTCTGAAGATTT<br>TGCAGTTTATTACTGTCAGCAGTACAATCAGTGGCCTCCGATCACTTTCG<br>GCGGAGGGACCAAGGTGGAAATCAAA |
| 167 | 2666 | 698 | EIVLTQSPATLSVSPGERATLSCRASQSIGTNLAWYQQKPGQAPRLLIFGAST<br>RATGIPARFTGSGSGTEFTLTIGSLQSEDFAVYYCQQYNQWPPITFGGGTKV<br>EIK |
| 167 | 2667 | 699 | RASQSIGTNLA |
| 167 | 2668 | 700 | AGGGCCAGTCAGAGTATTGGCACCAACTTGGCC |
| 167 | 2669 | 701 | GASTRAT |
| 167 | 2670 | 702 | GGTGCCTCAACCAGGGCCACG |
| 167 | 2671 | 703 | QQYNQWPPIT |
| 167 | 2672 | 704 | CAGCAGTACAATCAGTGGCCTCCGATCACT |

TABLE 6-continued

Informal Sequence Listing

| Antibody No. | Seq. Ref. No. | SEQ ID NO. | Sequence |
|---|---|---|---|
| 168 | 2673 | 705 | GAGGTGCAGCTGTTGGAGTCTGGGGGAGGCGTGGTCCAGCCTGGGAAGT<br>CCCTGAGACTCTCCTGTGTAGCCTCTGGATTCACCTTCGGTGACTATGGC<br>ATGCACTGGGTCCGCCAGGCTCCAGGCAAGGGGCTGGAGTGGGTGGCAG<br>TTATATCAGATGGTGGAAGCACTAAATACTATGCAGACTCCGTGAAGGG<br>CCGATTCACCATCGCCAGAGACAATTCCAAGAACACGCTGAATCTGCAA<br>ATGAACAGCCTGAGAGCTGAGGACACGGCTGTGTATTACTGTGCGAAAG<br>ATTTGGCTTGGATTTTTGGACTGGGTGCTTCATATATGGACGTCTGGGGC<br>CAAGGGACCCTGGTCACCGTCTCCTCA |
| 168 | 2674 | 706 | EVQLLESGGGVVQPGKSLRLSCVASGFTFGDYGMHWVRQAPGKGLEWVA<br>VISDGGSTKYYADSVKGRFTIARDNSKNTLNLQMNSLRAEDTAVYYCAKD<br>LAWIFGLGASYMDVWGQGTLVTVSS |
| 168 | 2675 | 707 | FTFGDYGMH |
| 168 | 2676 | 708 | TTCACCTTCGGTGACTATGGCATGCAC |
| 168 | 2677 | 709 | VISDGGSTKYYADSVKG |
| 168 | 2678 | 710 | GTTATATCAGATGGTGGAAGCACTAAATACTATGCAGACTCCGTGAAGG<br>GC |
| 168 | 2679 | 711 | AKDLAWIFGLGASYMDV |
| 168 | 2680 | 712 | GCGAAAGATTTGGCTTGGATTTTTGGACTGGGTGCTTCATATATGGACGT<br>C |
| 168 | 2681 | 713 | GACATCCAGTTGACCCAGTCTCCAGGCACCCTGTCTTTGTCTCCAGGGGA<br>AAGAGCCACCCTCTCCTGCAGGGCCAGTCAGACTGTTAGTAGCAGCTAC<br>TTAGCCTGGTACCAGCAGAAACCTGGCCAGGCTCCCAGGCTCCTCATCT<br>ATGATGCATCCAGCAGGGCCACTGGCATCCCAGACAGGTTCAGTGGCAG<br>TGGGTCTGGGACAGACTTCACTCTCACCATCAGCAGACTGGAGCCTGAA<br>GATTTTGCAGTGTATTACTGTCAGCAGTATGGTAGCTCACCTTTCGGGCT<br>CACTTTCGGCGGAGGGACCAAGGTGGAAATCAAA |
| 168 | 2682 | 714 | DIQLTQSPGTLSLSPGERATLSCRASQTVSSSYLAWYQQKPGQAPRLLIYDA<br>SSRATGIPDRFSGSGSGTDFTLTISRLEPEDFAVYYCQQYGSSPFGLTFGGGT<br>KVEIK |
| 168 | 2683 | 715 | RASQTVSSSYLA |
| 168 | 2684 | 716 | AGGGCCAGTCAGACTGTTAGTAGCAGCTACTTAGCC |
| 168 | 2685 | 717 | DASSRAT |
| 168 | 2686 | 718 | GATGCATCCAGCAGGGCCACT |
| 168 | 2687 | 719 | QQYGSSPFGLT |
| 168 | 2688 | 720 | CAGCAGTATGGTAGCTCACCTTTCGGGCTCACT |
| 169 | 2689 | 721 | CAGGTCCAGCTGGTGCAGTCTGGGGGAGGCTTGGTACAGCCGGGGGGGT<br>CCCTGCGACTCTCCTGTGCAGCCTCTGGATTCACCTTTGGGAGACATGCC<br>ATGACGTGGGTCCGCCAGGCTCCAGGGAAGGGGCTGGAGTGGGTCGCA<br>GGCATTACTGCTACTGGGGACCCCACATACTACCCAGACTCCGTGAAGG<br>GCCGGTTCGCCGTCTCCAGAGACAACTCCCGGAACACGCTTTATCTGCA<br>AATGGACAGTCTGAGAGTCGAGGACACGGCCCTATATTACTGTGCGAGA<br>AGTTGGGATGACTACGGTGACCTGGACTGGTACTTCGCTCTCTGGGGCC<br>GTGGCACAATGGTCACCGTCTCTTCA |
| 169 | 2690 | 722 | QVQLVQSGGGLVQPGGSLRLSCAASGFTFGRHAMTWVRQAPGKGLEWVA<br>GITATGDPTYYPDSVKGRFAVSRDNSRNTLYLQMDSLRVEDTALYYCARS<br>WDDYGDLDWYFALWGRGTMVTVSS |
| 169 | 2691 | 723 | FTFGRHAMT |
| 169 | 2692 | 724 | TTCACCTTTGGGAGACATGCCATGACG |
| 169 | 2693 | 725 | GITATGDPTYYPDSVKG |
| 169 | 2694 | 726 | GGCATTACTGCTACTGGGGACCCCACATACTACCCAGACTCCGTGAAGG<br>GC |

TABLE 6-continued

Informal Sequence Listing

| Antibody No. | Seq. Ref. No. | SEQ ID NO. | Sequence |
|---|---|---|---|
| 169 | 2695 | 727 | ARSWDDYGDLDWYFAL |
| 169 | 2696 | 728 | GCGAGAAGTTGGGATGACTACGGTGACCTGGACTGGTACTTCGCTCTC |
| 169 | 2697 | 729 | GAAATTGTGATGACACAGTCTCCAGCCATCCTGTCTGTGTCTCCAGGGGA<br>AAGAGCCACCCTCTCCTGCAGGGCCAGTCAGAGTGTTAGCAGCAGCTTG<br>GCCTGGTACCAGCAGAAACCTGGCCAGGCTCCTAGGCTCCTCATCTACG<br>GTGCATCCACCAGGGCCACTGGTATCCCACCCCGGTTCAGTGGCAGTGG<br>GTCTGGGACACAATTCACTCTCACCATCAGCAGCCTGCAGTCTGAAGAT<br>GTTGCAGTATATTACTGTCAGCAGTATAGTGACTGGCCTCCGCTCACTTT<br>CGGCGGGGGGACCAAGGTGGAAATCAAA |
| 169 | 2698 | 730 | EIVMTQSPAILSVSPGERATLSCRASQSVSSSLAWYQQKPGQAPRLLIYGAST<br>RATGIPPRFSGSGSGTQFTLTISSLQSEDVAVYYCQQYSDWPPLTFGGGTKV<br>EIK |
| 169 | 2699 | 731 | RASQSVSSSLA |
| 169 | 2700 | 732 | AGGGCCAGTCAGAGTGTTAGCAGCAGCTTGGCC |
| 169 | 2701 | 733 | GASTRAT |
| 169 | 2702 | 734 | GGTGCATCCACCAGGGCCACT |
| 169 | 2703 | 735 | QQYSDWPPLT |
| 169 | 2704 | 736 | CAGCAGTATAGTGACTGGCCTCCGCTCACT |
| 170 | 2705 | 737 | GAGGTGCAGCTGTTGGAGTCTGGGGGAGGCTTGGTCAAGCCTGGAGGGT<br>CCCTGAGACTCTCCTGTGGAGCCTCTGGATTCAAGTTCAGTGACTACTAC<br>ATGAGTTGGATCCGCCAGGCTCCAGGGAAGGGGCTAGAGTGGGTTTCAC<br>ACATTAGTAGTAGTAATAGTTACATAAACTACGCAGACTCTGTGAAGGG<br>CCGATTCACCATCTCCAGGGACAACGCCAGGAACTCACTGTCTCTGCAA<br>ATGAACAGCCTGAGAGCCGAGGACACGGCCGTGTATTACTGTGCGAGAT<br>TCCCCCTTTACTGTAGTCGTTCCTCCTGCTCCCATTACGTTGACTACTGGG<br>GCCAGGGAACCCTGGTCACCGTCTCCTCA |
| 170 | 2706 | 738 | EVQLLESGGGLVKPGGSLRLSCGASGFKFSDYYMSWIRQAPGKGLEWVSHI<br>SSSNSYINYADSVKGRFTISRDNARNSLSLQMNSLRAEDTAVYYCARFPLYC<br>SRSSCSHYVDYWGQGTLVTVSS |
| 170 | 2707 | 739 | FKFSDYYMS |
| 170 | 2708 | 740 | TTCAAGTTCAGTGACTACTACATGAGT |
| 170 | 2709 | 741 | HISSSNSYINYADSVKG |
| 170 | 2710 | 742 | CACATTAGTAGTAGTAATAGTTACATAAACTACGCAGACTCTGTGAAGG<br>GC |
| 170 | 2711 | 743 | ARFPLYCSRSSCSHYVDY |
| 170 | 2712 | 744 | GCGAGATTCCCCCTTTACTGTAGTCGTTCCTCCTGCTCCCATTACGTTGAC<br>TAC |
| 170 | 2713 | 745 | CAGTCTGTCCTGACTCAGCCTCCCTCAGTGTCTGGGGCCCCAGGGCAGA<br>GGGTCACCATCTCCTGCACTGGGAGCGGCTCCAACATCGGGGCAGGTTA<br>TGATGTACACTGGTACCAGCAGCTTCCAGGAACAGCCCCCAAACTCCTC<br>ATCTATGATAACAACAATCGGCCCTCAGGGGTCCCTGACCGATTCTCTGG<br>CTCCAAGTCTGGCACCTCAGCCTCCCTGGCCATCACTGGGCTCCAGGTTG<br>AGGATGAGGCTGATTATTACTGCCAGTCCTATGACAGGAGCCTGAGTGT<br>GGTATTCGGCGGAGGGACCAAGGTCACCGTCCTA |
| 170 | 2714 | 746 | QSVLTQPPSVSGAPGQRVTISCTGSGSNIGAGYDVHWYQQLPGTAPKWYD<br>NNNRPSGVPDRFSGSKSGTSASLAITGLQVEDEADYYCQSYDRSLSVVFGG<br>GTKVTVL |
| 170 | 2715 | 747 | TGSGSNIGAGYDVH |
| 170 | 2716 | 748 | ACTGGGAGCGGCTCCAACATCGGGGCAGGTTATGATGTACAC |
| 170 | 2717 | 749 | DNNNRPS |
| 170 | 2718 | 750 | GATAACAACAATCGGCCCTCA |

TABLE 6-continued

Informal Sequence Listing

| Antibody No. | Seq. Ref. No. | SEQ ID NO. | Sequence |
|---|---|---|---|
| 170 | 2719 | 751 | QSYDRSLSVV |
| 170 | 2720 | 752 | CAGTCCTATGACAGGAGCCTGAGTGTGGTA |
| 171 | 2721 | 753 | CAGGTGCAGCTGGTGCAATCTGGACCAGAGGTGAAAAAGCCCGGGGAG<br>TCTCTGAAGATCTCCTGTAAGGGTTCTGGATATACGTTTACTACCTACTG<br>GATCGGCTGGGTGCGCCAGAGGCCCGGGAAGGGCCTGGAGTGGATGGG<br>AATCATCCATCCCGGTGACTCTGATACCAGATACAGTCCGTCCTTACAAG<br>GCCAGGTCACCATCTCAGTCGACAAGTCCATCAATACCGCCTACCTGCA<br>GTGGAGGAGTTTGAAGGCCTCGGACACCGGCATGTATTATTGTGCGAGA<br>TTCGAATACGGTGACTTCGGGAATGACTTCTGGGGCCAGGGAACCCTGG<br>TCACTGTCTCCTCA |
| 171 | 2722 | 754 | QVQLVQSGPEVKKPGESLKISCKGSGYTFTTYWIGWVRQRPGKGLEWMGII<br>HPGDSDTRYSPSLQGQVTISVDKSINTAYLQWRSLKASDTGMYYCARFEYG<br>DFGNDFWGQGTLVTVSS |
| 171 | 2723 | 755 | YTFTTYWIG |
| 171 | 2724 | 756 | TATACGTTTACTACCTACTGGATCGGC |
| 171 | 2725 | 757 | IIHPGDSDTRYSPSLQG |
| 171 | 2726 | 758 | ATCATCCATCCCGGTGACTCTGATACCAGATACAGTCCGTCCTTACAAGG<br>C |
| 171 | 2727 | 759 | ARFEYGDFGNDF |
| 171 | 2728 | 760 | GCGAGATTCGAATACGGTGACTTCGGGAATGACTTC |
| 171 | 2729 | 761 | AATTTTATGCTGACTCAGCCCCACTCTGTGTCGGAGTCTCCGGGGAAGAC<br>GGTAACCATCTCCTGCTCCCGCAGCAGTGGCAGCATTGCCAACAACTAT<br>GTGCAGTGGTACCAGCAGCGCCCGGGCAGTTCCCCCACCACTGTGATCT<br>ATGAGGATAACCAAAGACCCTCTGGGGTCCCTGATCGGTTCTCTGGCTCC<br>ATCGACAGCTCCTCCAACTCTGCCTCCCTCACCATCTCTGGACTGAAGAC<br>TGAGGACGAGGCAGACTACTACTGTCAGTCTTATGATAGTAGCAATCAT<br>AGGGTGTTCGGCGGAGGGACCAAGCTCACCGTCCTA |
| 171 | 2730 | 762 | NFMLTQPHSVSESPGKTVTISCSRSSGSIANNYVQWYQQRPGSSPTTVIYEDN<br>QRPSGVPDRFSGSIDSSSNSASLTISGLKTEDEADYYCQSYDSSNHRVFGGGT<br>KLTVL |
| 171 | 2731 | 763 | SRSSGSIANNYVQ |
| 171 | 2732 | 764 | TCCCGCAGCAGTGGCAGCATTGCCAACAACTATGTGCAG |
| 171 | 2733 | 765 | EDNQRPS |
| 171 | 2734 | 766 | GAGGATAACCAAAGACCCTCT |
| 171 | 2735 | 767 | QSYDSSNHRV |
| 171 | 2736 | 768 | CAGTCTTATGATAGTAGCAATCATAGGGTG |
| 172 | 2737 | 769 | GAGGTGCAGCTGTTGGAGTCTGGGGGAGGCTTGGTACAGCCTGGGGGGT<br>CCCTGCGACTCTCCTGTGCAGCCTCTGGATTCACCTTTAGGAGATATGCC<br>ATGACCTGGGTCCGCCAGGCTCCAGGGAAGGGGCTGGAGTGGGTCGCAG<br>CTATTACTGCTACTGGTGATACCACATACTACCCAGACTCCGTAAAGGGC<br>CGGTTCGCCGTCTCCAGAGACAATTCCCGGAACACGCTTTATCTGCAAAT<br>GGACAGTCTGAGAGCCGAGGACACGGCCCTATATTACTGTGCGAAAAGT<br>TGGGATGACTACGGTGACCTGGACTGGTACTTCGCTCTCTGGGGCCGTG<br>GCACCCTGGTCACCGTCTCCTCA |
| 172 | 2738 | 770 | EVQLLESGGGLVQPGGSLRLSCAASGFTFRRYAMTWVRQAPGKGLEWVAA<br>ITATGDTTYYPDSVKGRFAVSRDNSRNTLYLQMDSLRAEDTALYYCAKSW<br>DDYGDLDWYFALWGRGTLVTVSS |
| 172 | 2739 | 771 | FTFRRYAMT |
| 172 | 2740 | 772 | TTCACCTTTAGGAGATATGCCATGACC |
| 172 | 2741 | 773 | AITATGDTTYYPDSVKG |

TABLE 6-continued

Informal Sequence Listing

| Antibody No. | Seq. Ref. No. | SEQ ID NO. | Sequence |
|---|---|---|---|
| 172 | 2742 | 774 | GCTATTACTGCTACTGGTGATACCACATACTACCCAGACTCCGTAAAGG GC |
| 172 | 2743 | 775 | AKSWDDYGDLDWYFAL |
| 172 | 2744 | 776 | GCGAAAAGTTGGGATGACTACGGTGACCTGGACTGGTACTTCGCTCTC |
| 172 | 2745 | 777 | GATATTGTGATGACCCAGTCTCCAGCCATCCTGTCTGTGTCTCCAGGGGA AAGAGCCACCCTCTCCTGCAGGGCCAGTCAGAGTGTTAGCAGCAGCTTG GCCTGGTACCAGCAGAAACCTGGCCAGGCTCCCAGGCTCCTCATCTACG GTGCATCCACCAGGGCCACTGGTATCCCACCCCGGTTCAGTGGCAGTGG GTCTGGGACACAATTCACTCTCACCATCAGCAGCCTGCAGTCTGAAGATT TTGCAGTGTATTACTGTCAGCAGTATAGTGACTGGCCTCCGCTCACTTTC GGCGGGGGGACCAAGGTGGAGATCAAA |
| 172 | 2746 | 778 | DIVMTQSPAILSVSPGERATLSCRASQSVSSSLAWYQQKPGQAPRLLIYGAST RATGIPPRFSGSGSGTQFTLTISSLQSEDFAVYYCQQYSDWPPLTFGGGTKVE IK |
| 172 | 2747 | 779 | RASQSVSSSLA |
| 172 | 2748 | 780 | AGGGCCAGTCAGAGTGTTAGCAGCAGCTTGGCC |
| 172 | 2749 | 781 | GASTRAT |
| 172 | 2750 | 782 | GGTGCATCCACCAGGGCCACT |
| 172 | 2751 | 783 | QQYSDWPPLT |
| 172 | 2752 | 784 | CAGCAGTATAGTGACTGGCCTCCGCTCACT |
| 173 | 2753 | 785 | CAGGTCCAGCTTGTACAGTCTGGGGGAGGTTTGGTACAGCCTGGGGGGT CCCTGAGACTCTCCTGTGCAGCCTCTAGATTCACCTTTAGCAGCTATGCC ATGAGCTGGGTCCGCCAGGCTCCAGGGAAGGGGCTGGAGTGGGTCTCAA CTATTAGTGGTAGTGGTATTAGCACGTACTACGCAGACTCCGTGAAGGG CCGGTTCACCATCTCCAGAGACAATTCCAAGAACACGCTGTATCTGCAA ATGAACAGCCTGAGCGCCGAGGACACGGCCGTATATTACTGTGCGAAAG AATTGAGGGAGTATTACTATGATAGCAGTGGCTTTGACTACTGGGGCCA GGGAACCCTGGTCACCGTCTCCTCA |
| 173 | 2754 | 786 | QVQLVQSGGGLVQPGGSLRLSCAASRFTFSSYAMSWVRQAPGKGLEWVSTI SGSGISTYYADSVKGRFTISRDNSKNTLYLQMNSLSAEDTAVYYCAKELRE YYYDSSGFDYWGQGTLVTVSS |
| 173 | 2755 | 787 | FTFSSYAMS |
| 173 | 2756 | 788 | TTCACCTTTAGCAGCTATGCCATGAGC |
| 173 | 2757 | 789 | TISGSGISTYYADSVKG |
| 173 | 2758 | 790 | ACTATTAGTGGTAGTGGTATTAGCACGTACTACGCAGACTCCGTGAAGG GC |
| 173 | 2759 | 791 | AKELREYYYDSSGFDY |
| 173 | 2760 | 792 | GCGAAAGAATTGAGGGAGTATTACTATGATAGCAGTGGCTTTGACTAC |
| 173 | 2761 | 793 | CAGCCTGTGCTGACTCAGTCTCGCTCAGTGTCCGGGTCTCCTGAACAGTC AGTCACCATCTCCTGCACTGGAACCAGCAGTGATGTTGGTGGTTATAACT ATGTCTCCTGGTACCAACAGCACCCAGGCAAAGCCCCCAAACTCATGAT TTATGATGTCAGTAAGCGGCCCTCAGGGGTCCCTGATCGCTTCTCTGGCT CCAAGTCTGGCAACACGGCCTCCCTGACCATCTCTGGGCTCCAGGCTGA GGATGAGTCTGATTATTACTGCTGCTCATATGCAGGCACCTACACTTATG TCTTCGGAACTGGGACCAAGGTCACCGTCCTA |
| 173 | 2762 | 794 | QPVLTQSRSVSGSPEQSVTISCTGTSSDVGGYNYVSWYQQHPGKAPKLMIY DVSKRPSGVPDRFSGSKSGNTASLTISGLQAEDESDYYCCSYAGTYTYVFGT GTKVTVL |
| 173 | 2763 | 795 | TGTSSDVGGYNYVS |
| 173 | 2764 | 796 | ACTGGAACCAGCAGTGATGTTGGTGGTTATAACTATGTCTCC |
| 173 | 2765 | 797 | DVSKRPS |

TABLE 6-continued

Informal Sequence Listing

| Antibody No. | Seq. Ref. No. | SEQ ID NO. | Sequence |
|---|---|---|---|
| 173 | 2766 | 798 | GATGTCAGTAAGCGGCCCTCA |
| 173 | 2767 | 799 | CSYAGTYTYV |
| 173 | 2768 | 800 | TGCTCATATGCAGGCACCTACACTTATGTC |
| 174 | 2769 | 801 | GAGGTGCAGCTGTTGGAGTCTGGGGGAGGCGTGGTCCAGCCTGGGAGGT<br>CCCTGAAACTCTCCTGTGCAGCCTCTGGATTCAGCTTCACTACCGATGTT<br>ATGCACTGGATACGCCAGGCTCCAGGCAAGGGGCTGGAGTGGGTGGCA<br>GTTATTTCAACTGATGGAGCCAATTCATACTACGCAGAGTCCGTGAAGG<br>GCCGATTCACCATCTCCAGAGACAATTCCAAGAACACGCTGTTTCTGCA<br>GATGAGCAGCCTGAGAGCTGAGGACACGGCTGTGTATTATTGTGCGAGC<br>CAGGGATATCATTATGTTAATATGGCTGATGTGGGAGTGCCCTCGTTTGA<br>CCACTGGGGCCAGGGAACCCTGGTCACCGTCTCCTCA |
| 174 | 2770 | 802 | EVQLLESGGGVVQPGRSLKLSCAASGFSFTTDVMHWIRQAPGKGLEWVAVI<br>STDGANSYYAESVKGRFTISRDNSKNTLFLQMSSLRAEDTAVYYCASQGYH<br>YVNMADVGVPSFDHWGQGTLVTVSS |
| 174 | 2771 | 803 | FSFTTDVMH |
| 174 | 2772 | 804 | TTCAGCTTCACTACCGATGTTATGCAC |
| 174 | 2773 | 805 | VISTDGANSYYAESVKG |
| 174 | 2774 | 806 | GTTATTTCAACTGATGGAGCCAATTCATACTACGCAGAGTCCGTGAAGG<br>GC |
| 174 | 2775 | 807 | ASQGYHYVNMADVGVPSFDH |
| 174 | 2776 | 808 | GCGAGCCAGGGATATCATTATGTTAATATGGCTGATGTGGGAGTGCCCT<br>CGTTTGACCAC |
| 174 | 2777 | 809 | GAAACGACACTCACGCAGTCTCCATCCTCCCTGTCTGCATCTGTCGGAGA<br>CAGAGTCACCATCACTTGCCGGGCACGTCGGAGCATTGACAACTATTTA<br>AATTGGTATCAGCACAAACCAGGGACAGCCCCTAAGCTCCTGATCTATG<br>CTGTATCCAGTTTGCCTAGCGGGGTCCCATCGAGATTCAGTGGCAGTGG<br>ATCTGGGCAGACTTCACTCTCACCATCAGCAGTCTGCAACCTGAAGAT<br>CTTGCAACTTACTACTGTCAACAGAGTTACATGACCCCTCCCACTTTTGG<br>CCAGGGGACCAAGCTGGAGATCAAA |
| 174 | 2778 | 810 | ETTLTQSPSSLSASVGDRVTITCRARRSIDNYLNWYQHKPGTAPKLLIYAVSS<br>LPSGVPSRFSGSGSGADFTLTISSLQPEDLATYYCQQSYMTPPTFGQGTKLEI<br>K |
| 174 | 2779 | 811 | RARRSIDNYLN |
| 174 | 2780 | 812 | CGGGCACGTCGGAGCATTGACAACTATTTAAAT |
| 174 | 2781 | 813 | AVSSLPS |
| 174 | 2782 | 814 | GCTGTATCCAGTTTGCCTAGC |
| 174 | 2783 | 815 | QQSYMTPPT |
| 174 | 2784 | 816 | CAACAGAGTTACATGACCCCTCCCACT |
| 175 | 2785 | 817 | GAGGTGCAGCTGTTGGAGTCTGGGGCTGAGGTGAAGAAGCCTGGGTCCT<br>CGGTGAAGGTCTCCTGCAAGGCTTCTGGCGGCACCTTCAGCAGCTATGCT<br>ATAACCTGGGTGCGACAGGCCCCTGGACAAGGACTTGAGTGGATGGGAG<br>GGATCATCCCTATCCTTGGAACAACAACCTACGCACAGAGGTTCCAGGG<br>CAGAGTCACGATTACCGCGGACAAATCCACGACAACAGCCTACATGGAG<br>CTGAGTCGCCTGAGATCTGAGGACACGGCCGTCTATTACTGTGCGAAAA<br>CGGTGTCACAATATCCCAACACCTACAACTACGGCATGGACGTCTGGGG<br>CCAAGGGACCACGGTCACCGTCTCCTCA |
| 175 | 2786 | 818 | EVQLLESGAEVKKPGSSVKVSCKASGGTFSSYAITWVRQAPGQGLEWMGGI<br>IPILGTTTYAQRFQGRVTITADKSTTTAYMELSRLRSEDTAVYYCAKTVSQY<br>PNTYNYGMDVWGQGTTVTVSS |
| 175 | 2787 | 819 | GTFSSYAIT |
| 175 | 2788 | 820 | GGCACCTTCAGCAGCTATGCTATAACC |

TABLE 6-continued

Informal Sequence Listing

| Antibody No. | Seq. Ref. No. | SEQ ID NO. | Sequence |
|---|---|---|---|
| 175 | 2789 | 821 | GIIPILGTTTYAQRFQG |
| 175 | 2790 | 822 | GGGATCATCCCTATCCTTGGAACAACAACCTACGCACAGAGGTTCCAGGGC |
| 175 | 2791 | 823 | AKTVSQYPNTYNYGMDV |
| 175 | 2792 | 824 | GCGAAAACGGTGTCACAATATCCCAACACCTACAACTACGGCATGGACGTC |
| 175 | 2793 | 825 | GAAATTGTGATGACACAGTCTCCCTCCTCCCTGTCTGCATCTGTAGGAGACAGAGTCACCATCACTTGCCGGGCAAGTCAGAGCGTTAGCATCTATTTAAACTGGTATCAGCAGAAACCAGGGAAAACCCCTGAGCTCCTGATCTATGGTGCATCCCGTTTGCAAAGTGGGGTCCCATCAAGGTTCAGTGGCAGTGGATCTGGGACAGATTTCACTCTCACCATCAGCAGTCTGCAACCTGAAGATTTTGCAACTTACTACTGTCTACAGACGTACTCTACCCCCCTCACCTTCGGCCAAGGGACCAAGGTGGAAATCAAA |
| 175 | 2794 | 826 | EIVMTQSPSSLSASVGDRVTITCRASQSVSIYLNWYQQKPGKTPELLIYGASRLQSGVPSRFSGSGSGTDFTLTISSLQPEDFATYYCLQTYSTPLTFGQGTKVEIK |
| 175 | 2795 | 827 | RASQSVSIYLN |
| 175 | 2796 | 828 | CGGGCAAGTCAGAGCGTTAGCATCTATTTAAAC |
| 175 | 2797 | 829 | GASRLQS |
| 175 | 2798 | 830 | GGTGCATCCCGTTTGCAAAGT |
| 175 | 2799 | 831 | LQTYSTPLT |
| 175 | 2800 | 832 | CTACAGACGTACTCTACCCCCCTCACC |
| 176 | 2801 | 833 | CAGGTGCAGCTGGTGGAGTCTGGGGCTGAGGTGAAGAAGCCTGGGTCCTCGGTGAAGGTCTCCTGCAAGGCTTCTGGAGGCACCTTCGGCAGGGATTCTATCAGCTGGGTGCGACAGGCCCCTGGGCAGGGCCTTGAGTGGATGGGAGGGATCAACCCTATCTTTCATACATCACACTACGCACAGAAATTCCAGGGCAGAGTCACAATTACCGCGGACGAGTCCACGAGCACAGCCTACATGGAACTGGGCAACCTGAGATCTGAGGACACGGCCATGTATTACTGTGCGAGAGTTCCCCCCCCCCGGGGTCATTGTGAGAGTACCAGCTGTTTATGGGGGACCTATTTTGCCTTCTGGGGCCAGGGAACCCTGGTCACCGTCTCCTCA |
| 176 | 2802 | 834 | QVQLVESGAEVKKPGSSVKVSCKASGGTFGRDSISWVRQAPGQGLEWMGGINPIFHTSHYAQKFQGRVTITADESTSTAYMELGNLRSEDTAMYYCARVPPPRGHCESTSCLWGTYFAFWGQGTLVTVSS |
| 176 | 2803 | 835 | GTFGRDSIS |
| 176 | 2804 | 836 | GGCACCTTCGGCAGGGATTCTATCAGC |
| 176 | 2805 | 837 | GINPIFHTSHYAQKFQG |
| 176 | 2806 | 838 | GGGATCAACCCTATCTTTCATACATCACACTACGCACAGAAATTCCAGGGC |
| 176 | 2807 | 839 | ARVPPPRGHCESTSCLWGTYFAF |
| 176 | 2808 | 840 | GCGAGAGTTCCCCCCCCCCGGGGTCATTGTGAGAGTACCAGCTGTTTATGGGGGACCTATTTTGCCTTC |
| 176 | 2809 | 841 | GAAACGACACTCACGCAGTCTCCAGCCACCCTGTCTTTGTCTCCAGGGGAAAGAGCCACCCTCTCCTGCAGGGCCAGTCAGAGGGTTCGCAGCTACTTAGCCTGGTACCAGCAGAAACCTGGCCAGGCTCCCAGGCTCCTCATCTATGATGCATCCATCAGGGCTACTGGCATCCCAGCCAGGTTCAGTGGCAGTGGGTCTGGGGCAGACTTCACTCTCACCATCAGCAGCCTCGAGCCTGAAGATTTTGCAGTTTATTACTGTCAGCTGCGTGACTACTGGCCTCCCACGTGGACGTTCGGCCAAGGGACCAAGGTGGAAATCAAA |
| 176 | 2810 | 842 | ETTLTQSPATLSLSPGERATLSCRASQRVRSYLAWYQQKPGQAPRLLIYDASIRATGIPARFSGSGSGADFTLTISSLEPEDFAVYYCQLRDYWPPTWTFGQGTKVEIK |
| 176 | 2811 | 843 | RASQRVRSYLA |

TABLE 6-continued

Informal Sequence Listing

| Antibody No. | Seq. Ref. No. | SEQ ID NO. | Sequence |
|---|---|---|---|
| 176 | 2812 | 844 | AGGGCCAGTCAGAGGGTTCGCAGCTACTTAGCC |
| 176 | 2813 | 845 | DASIRAT |
| 176 | 2814 | 846 | GATGCATCCATCAGGGCTACT |
| 176 | 2815 | 847 | QLRDYWPPTWT |
| 176 | 2816 | 848 | CAGCTGCGTGACTACTGGCCTCCCACGTGGACG |
| 177 | 2817 | 849 | GAGGTGCAGCTGTTGGAGTCTGGGGGAGACCTGGTACAGCCGGGGGGT CCCTGAGACTCTCCTGTGCAGCCTCTGGATTCCCCTTCAGCAGCCATAGC ATGAACTGGGTCCGCCAGGCTCCAGGGAAGGGCCTGGAGTGGATCTCAT ACATTAGTGGTGGTAGTGATACCATTCAGTACGCAGACTCTGTGAAGGG CCGATTTACCATCTCCAGAGACAATGTCAAGAATTCACTGTATCTGCAAA TGAACAGCCTGAGAGCCGAGGACACGGCTGTCTATTACTGTGCGAGAGA CCAGTATATTTGGAACTATGTGGAACCTCTTGACTACTGGGGCCAGGGA ACCCTGGTCACCGTCTCCTCA |
| 177 | 2818 | 850 | EVQLLESGGDLVQPGGSLRLSCAASGFPFSSHSMNWVRQAPGKGLEWISYIS GGSDTIQYADSVKGRFTISRDNVKNSLYLQMNSLRAEDTAVYYCARDQYI WNYVEPLDYWGQGTLVTVSS |
| 177 | 2819 | 851 | FPFSSHSMN |
| 177 | 2820 | 852 | TTCCCCTTCAGCAGCCATAGCATGAAC |
| 177 | 2821 | 853 | YISGGSDTIQYADSVKG |
| 177 | 2822 | 854 | TACATTAGTGGTGGTAGTGATACCATTCAGTACGCAGACTCTGTGAAGG GC |
| 177 | 2823 | 855 | ARDQYIWNYVEPLDY |
| 177 | 2824 | 856 | GCGAGAGACCAGTATATTTGGAACTATGTGGAACCTCTTGACTAC |
| 177 | 2825 | 857 | GACATCCAGATGACCCAGTCTCCATCCTCCCTGTCTGCATCTGTAGGAGA CAGAGTCACCATCACTTGCCGGGCAAGTCAGGACATTAGCTATTATTTA GGCTGGTATCAGCAGAAAGCAGGGAAAGCCCCGAAGCTCCTGATTTATG CTGTATCCAATTTGCAAACTGGGGTCCCATCAAGGTTCAGCGGCAGTGG ATCTGGGACAGATTTCACTCTCACCATCAGCAGCCTGCAGCCTGAAGATT TCGCAACTTATTATTGTCTACAAGATCACACTTGCCCTTGGACGTTCGGC CAAGGGACCAAGGTGGAAATCAAA |
| 177 | 2826 | 858 | DIQMTQSPSSLSASVGDRVTITCRASQDISYYLGWYQQKAGKAPKLLIYAVS NLQTGVPSRFSGSGSGTDFTLTISSLQPEDFATYYCLQDHTCPWTFGQGTKV EIK |
| 177 | 2827 | 859 | RASQDISYYLG |
| 177 | 2828 | 860 | CGGGCAAGTCAGGACATTAGCTATTATTTAGGC |
| 177 | 2829 | 861 | AVSNLQT |
| 177 | 2830 | 862 | GCTGTATCCAATTTGCAAACT |
| 177 | 2831 | 863 | LQDHTCPWT |
| 177 | 2832 | 864 | CTACAAGATCACACTTGCCCTTGGACG |
| 178 | 2833 | 865 | GAGGTGCAGCTGGTGGAGTCTGGGGCTGAGGTGAAGAAGCCTGGGTCCT CGGTGAAAGTCTCCTGCAAGGTTTCTGGAGGCACCTTCAGCACTTATGGT ATCAGCTGGATACAACAGGCCCCTGGACAAGGGCTTGAGTGGGTGGGAG GGATCATCCCTATGTTTGGGACAGCAAACTACGCACAGAGGTTTCAGGG CAGAGTCACCCTTACCGCGGACGAAGGCACGAACACAGCTTACATGGAG CTGAACAACCTGAGATCTGAGGACACGGCCATGTATTACTGTGCGAGAG ATCGAGGTAATAACGGCCGCTACACGCTATGGACGTCTGGGGCCAGGG GACCACGGTCACCGTCTCCTCA |
| 178 | 2834 | 866 | EVQLVESGAEVKKPGSSVKVSCKVSGGTFSTYGISWIQQAPGQGLEWVGGII PMFGTANYAQRFQGRVTLTADEGTNTAYMELNNLRSEDTAMYYCARDRG NNGRYYAMDVWGQGTTVTVSS |

TABLE 6-continued

Informal Sequence Listing

| Antibody No. | Seq. Ref. No. | SEQ ID NO. | Sequence |
|---|---|---|---|
| 178 | 2835 | 867 | GTFSTYGIS |
| 178 | 2836 | 868 | GGCACCTTCAGCACTTATGGTATCAGC |
| 178 | 2837 | 869 | GIIPMFGTANYAQRFQG |
| 178 | 2838 | 870 | GGGATCATCCCTATGTTTGGGACAGCAAACTACGCACAGAGGTTTCAGGGC |
| 178 | 2839 | 871 | ARDRGNNGRYYAMDV |
| 178 | 2840 | 872 | GCGAGAGATCGAGGTAATAACGGCCGCTACTACGCTATGGACGTC |
| 178 | 2841 | 873 | GATATTGTGCTGACCCAGACTCCAGCCACCCTGTCTTTGTCTCCAGGGGAAAGAGCCACCCTCTCCTGCAGGGCCAGTCAGAGTGTCACCACCTACTTAGCGTGGTACCAACAGAAACCTGGCCAGGCTCCCAGGCTCCTCATCTATGATACATCCAACAGGGCCACTGGCATCCCAGCCAGGTTCAGTGGCAGTGGGTCTGGGACAGACTTCACTCTCACCATCAGCAGCCTAGAGCCTGAAGATTTTGCAGTTTATTACTGTCAGCAGCGTAACAACTGGCCGCCGACCTTCGGCCAAGGGACACGACTGGAGATTAAA |
| 178 | 2842 | 874 | DIVLTQTPATLSLSPGERATLSCRASQSVTTYLAWYQQKPGQAPRLLIYDTSNRATGIPARFSGSGSGTDFTLTISSLEPEDFAVYYCQQRNNWPPTFGQGTRLEIK |
| 178 | 2843 | 875 | RASQSVTTYLA |
| 178 | 2844 | 876 | AGGGCCAGTCAGAGTGTCACCACCTACTTAGCG |
| 178 | 2845 | 877 | DTSNRAT |
| 178 | 2846 | 878 | GATACATCCAACAGGGCCACT |
| 178 | 2847 | 879 | QQRNNWPPT |
| 178 | 2848 | 880 | CAGCAGCGTAACAACTGGCCGCCGACC |
| 179 | 2849 | 881 | GAGGTGCAGCTGTTGGAGTCTGGGGGAGGCCTGGTCAAGCCTGGGGGGTCCCTGAGACTCTCCTGTGCAGCCTCGGGATTCACCATCAGTGGTTATAACATGTTCTGGGTCCGCCAGCCTCCGGGGAAGGGGCTGGAGTGGGTCTCATCCATTACTGCTGGTAGTAGTTATTTAAACTATGCAGACTCAGTGAAGGGCCGTTTCATCGTCTCCAGAGACAACGCCAAGAATTCACTGTATCTGCAAATGAACAGCCTGAGAGCCGAGGACACGGCTGTTTATTTCTGTGCGAGAGCACCTCTTTTACCCGCTATGATGGACCTCTGGGGCCAAGGGACCACGGTCACCGTCTCCTCA |
| 179 | 2850 | 882 | EVQLLESGGGLVKPGGSLRLSCAASGFTISGYNMFWVRQPPGKGLEWVSSITAGSSYLNYADSVKGRFIVSRDNAKNSLYLQMNSLRAEDTAVYFCARAPLLPAMMDLWGQGTTVTVSS |
| 179 | 2851 | 883 | FTISGYNMF |
| 179 | 2852 | 884 | TTCACCATCAGTGGTTATAACATGTTC |
| 179 | 2853 | 885 | SITAGSSYLNYADSVKG |
| 179 | 2854 | 886 | TCCATTACTGCTGGTAGTAGTTATTTAAACTATGCAGACTCAGTGAAGGGC |
| 179 | 2855 | 887 | ARAPLLPAMMDL |
| 179 | 2856 | 888 | GCGAGAGCACCTCTTTTACCCGCTATGATGGACCTC |
| 179 | 2857 | 889 | CAGTCTGTCTTGACGCAGCCGCCCTCAGTGTCTGGGGCCCCAGGGCAGAGGGTCACCATCTCCTGCACTGGGAGCAGCTCCAACATCGGGGCAGGTTATGATGTACACTGGTACCAGCAACTTCCAGGAACAGCCCCCAAACTCCTCATCTATACTAACAACAATCGGCCCTCAGGGGTCCCTGACCGATTCTCTGGCTCCAAGTCTGGCACCTCAGCCTCCCTGGCCATCACTGGGCTCCAGGCTGAGGATGAGGCTGACTATTACTGCCAGTCCTATGACAGAAGCCTGAATGGTTATGTCTTCGGAACTGGGACCAAGCTCACCGTCCTA |
| 179 | 2858 | 890 | QSVLTQPPSVSGAPGQRVTISCTGSSSNIGAGYDVHWYQQLPGTAPKLLIYTNNNRPSGVPDRFSGSKSGTSASLAITGLQAEDEADYYCQSYDRSLNGYVFGTGTKLTVL |

TABLE 6-continued

Informal Sequence Listing

| Antibody No. | Seq. Ref. No. | SEQ ID NO. | Sequence |
|---|---|---|---|
| 179 | 2859 | 891 | TGSSSNIGAGYDVH |
| 179 | 2860 | 892 | ACTGGGAGCAGCTCCAACATCGGGGCAGGTTATGATGTACAC |
| 179 | 2861 | 893 | TNNNRPS |
| 179 | 2862 | 894 | ACTAACAACAATCGGCCCTCA |
| 179 | 2863 | 895 | QSYDRSLNGYV |
| 179 | 2864 | 896 | CAGTCCTATGACAGAAGCCTGAATGGTTATGTC |
| 180 | 2865 | 897 | GAGGTGCAGCTGGTGGAGACTGGGGGAGGCCTGGTCAAGCCTGGGGGG<br>TCCCTGAGACTCTCCTGTGCAGGCTCTGGATTCACCTTCAGTAGCTATAC<br>CCTGAACTGGGTCCGCCAGGCTCCAGGGAAGGGGCTGGAGTGGGTCTCA<br>TCTATTAGTAGTAGTAGTACTTACATATACTACGCAGACTCAGTGAAGG<br>GCCGATTCACCATCTCCAGAGACAACGCCAAGAACTCACTGCATCTGCA<br>AATGAACAGCCTGAGAGCCGAGGACACGGCTGTGTATTATTGTGCGAGA<br>GCTGACTATGATAGAAGTGTTTATCACCTCAATTGGCTCGACCCCTGGGG<br>CCAGGGAACCCTGGTCACCGTCTCCTCA |
| 180 | 2866 | 898 | EVQLVETGGGLVKPGGSLRLSCAGSGFTFSSYTLNWVRQAPGKGLEWVSSI<br>SSSSTYIYYADSVKGRFTISRDNAKNSLHLQMNSLRAEDTAVYYCARADYD<br>RSVYHLNWLDPWGQGTLVTVSS |
| 180 | 2867 | 899 | FTFSSYTLN |
| 180 | 2868 | 900 | TTCACCTTCAGTAGCTATACCCTGAAC |
| 180 | 2869 | 901 | SISSSSTYIYYADSVKG |
| 180 | 2870 | 902 | TCTATTAGTAGTAGTAGTACTTACATATACTACGCAGACTCAGTGAAGG<br>GC |
| 180 | 2871 | 903 | ARADYDRSVYHLNWLDP |
| 180 | 2872 | 904 | GCGAGAGCTGACTATGATAGAAGTGTTTATCACCTCAATTGGCTCGACC<br>CC |
| 180 | 2873 | 905 | CAGCCTGTGCTGACTCAGCCGCCCTCAGTGTCTGGGGCCCCAGGGCAGA<br>GGGTCACCATCTCCTGCACTGGGAGCAGCTCCAACATCGGGGCAGGTTA<br>TGATGTACACTGGTACCAGCAACTTCCAGGAGCAGCCCCCAAACTCCTC<br>ATCTATGGTAACACCAATCGGCCCTCAGGGGTCCCTGACCGATTTTCTGG<br>CTCCAAGTCTGGCACCTCAGCCTCCCTGGCCATCACTGGGCTCCAGGCTG<br>ACGATGAGGCTGATTATTACTGCCAGTCCTATGACAGCAGCCTGAGTGG<br>CACTTGGGTGTTCGGCGGAGGGACCAAGCTCACCGTCCTA |
| 180 | 2874 | 906 | QPVLTQPPSVSGAPGQRVTISCTGSSSNIGAGYDVHWYQQLPGAAPKLLIYG<br>NTNRPSGVPDRFSGSKSGTSASLAITGLQADDEADYYCQSYDSSLSGTWVF<br>GGGTKLTVL |
| 180 | 2875 | 907 | TGSSSNIGAGYDVH |
| 180 | 2876 | 908 | ACTGGGAGCAGCTCCAACATCGGGGCAGGTTATGATGTACAC |
| 180 | 2877 | 909 | GNTNRPS |
| 180 | 2878 | 910 | GGTAACACCAATCGGCCCTCA |
| 180 | 2879 | 911 | QSYDSSLSGTWV |
| 180 | 2880 | 912 | CAGTCCTATGACAGCAGCCTGAGTGGCACTTGGGTG |
| 181 | 2881 | 913 | CAGGTGCAGCTGGTGCAGTCTGGGGGAGGCTTGGTCAAGCCTGGAGGGT<br>CCCTGAGACTCTCCTGTGCAGCCTCTGGATTCACCTTCAGTGACCACTAC<br>ATGACCTGGATCCGCCAGGCTCCAGGGAAGGGGCTGGAGTGGGTTTCAT<br>ACATTAGCAGTACTAGTAGTTTCACAAACTACGCAGACTCTGTGAAGGG<br>CCGATTCACCATCTCCAGAGACAACGCCAAGAAGTCACTTTATCTGCAA<br>ATGAACAGCCTGAGAGCCGAGGACACGGCTGTGTATTACTGTGCGAGAG<br>ACCGCAATTGGGGATATGCCTATGGTTCTGACTACTGGGGCCAGGGAAC<br>CCTGGTCACCGTCTCCTCA |

TABLE 6-continued

Informal Sequence Listing

| Antibody No. | Seq. Ref. No. | SEQ ID NO. | Sequence |
|---|---|---|---|
| 181 | 2882 | 914 | QVQLVQSGGGLVKPGGSLRLSCAASGFTFSDHYMTWIRQAPGKGLEWVSYISSTSSFTNYADSVKGRFTISRDNAKKSLYLQMNSLRAEDTAVYYCARDRNWGYAYGSDYWGQGTLVTVSS |
| 181 | 2883 | 915 | FTFSDHYMT |
| 181 | 2884 | 916 | TTCACCTTCAGTGACCACTACATGACC |
| 181 | 2885 | 917 | YISSTSSFTNYADSVKG |
| 181 | 2886 | 918 | TACATTAGCAGTACTAGTAGTTTCACAAACTACGCAGACTCTGTGAAGGGC |
| 181 | 2887 | 919 | ARDRNWGYAYGSDY |
| 181 | 2888 | 920 | GCGAGAGACCGCAATTGGGGATATGCCTATGGTTCTGACTAC |
| 181 | 2889 | 921 | GACATCCGGTTGACCCAGTCTCCAGACACCCTGTCTTTGTCTCCAGGGGAAAGAGCCACCCTCTCCTGCAGGGCCAGTCAGAGTGTTAGCAGCACCTACTTAGCCTGGTACCAGCAGAAACCTGGCCAGGCTCCCAGGCTCCTCATTTATGGTGCATTCGGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATTACTGTCAGCTGTATGGTAACTCACGGACGTTCGGCCAAGGGACCAAGCTGGAGATCAAA |
| 181 | 2890 | 922 | DIRLTQSPDTLSLSPGERATLSCRASQSVSSTYLAWYQQKPGQAPRLLIYGAFGRATGIPDRFSGSGSGTDFTLTISRLEPEDFAVYYCQLYGNSRTFGQGTKLEIK |
| 181 | 2891 | 923 | RASQSVSSTYLA |
| 181 | 2892 | 924 | AGGGCCAGTCAGAGTGTTAGCAGCACCTACTTAGCC |
| 181 | 2893 | 925 | GAFGRAT |
| 181 | 2894 | 926 | GGTGCATTCGGCAGGGCCACT |
| 181 | 2895 | 927 | QLYGNSRT |
| 181 | 2896 | 928 | CAGCTGTATGGTAACTCACGGACG |
| 182 | 2897 | 929 | GAGGTGCAGCTGGTGGAGTCTGGGGGAGGCTTGGTACAGCCTGGGGGGTCCCTGAGAATCTCCTGTGCAGCCTCTGGATTCTCCATTAGTAGTCATGCCGTGAGCTGGGTCCGCCAGGCTCCAGGGAAGGGGCTGGAGTGGGTCTCAGTTATTAGTGGGAGTGGTGGTGACACACACTCCGTAGTTCAAGGTCGTGGTAGTGGCACATATTACGCAGACTCCGTGAAGGGCCGGTTCACCATCTCCAGAGACAATGTCAGGAACACAGTGTATCTGCAAATGAATAGCCTGAGGGTCGAGGACACGGCCGTATATTATTGTGCGAAAGACGACCCCACGCTTTTTTGGAGTGGTTCGGGGTACTACGGAATGGACGTCTGGGGCCAAGGGACCACGGTCACCGTCTCCTCA |
| 182 | 2898 | 930 | EVQLVESGGGLVQPGGSLRISCAASGFSISSHAVSWVRQAPGKGLEWVSISGSGGDTHSVVQGRGSGTYYADSVKGRFTISRDNVRNTVYLQMNSLRVEDTAVYYCAKDDPTLFWSGSGYYGMDVWGQGTTVTVSS |
| 182 | 2899 | 931 | FSISSHAVS |
| 182 | 2900 | 932 | TTCTCCATTAGTAGTCATGCCGTGAGC |
| 182 | 2901 | 933 | VISGSGGDTHSVVQGRGSGTYYADSVKG |
| 182 | 2902 | 934 | GTTATTAGTGGGAGTGGTGGTGACACACACTCCGTAGTTCAAGGTCGTGGTAGTGGCACATATTACGCAGACTCCGTGAAGGGC |
| 182 | 2903 | 935 | AKDDPTLFWSGSGYYGMDV |
| 182 | 2904 | 936 | GCGAAAGACGACCCCACGCTTTTTTGGAGTGGTTCGGGGTACTACGGAATGGACGTC |
| 182 | 2905 | 937 | GACATCCGGGTGACCCAGTCTCCATCCTCCCTGTCTGCATCTGTTGGAGACAGAGTCACCATCACTTGCCAGGCGAGTCAGGGCATTAGCGACTCTTTAAATTGGTATCAGCAGAAACCAGGGAAAGCCCCTAAGCTCCTGATCTACGGTGCATCCAAATTGGAACCAGGGGTCTCATCAAGGTTCAGCGGACGAGG |

TABLE 6-continued

Informal Sequence Listing

| Antibody No. | Seq. Ref. No. | SEQ ID NO. | Sequence |
|---|---|---|---|
| | | | ATCTGGGAGAGATTTTACTTTCACCATCAGCAGCCTGCAGCCTGAAGAT ATCGGAACATATTACTGTCAACAGTATGATAATCTCCCTCTGACTTTCGG CCCTGGGACCAAGCTGGAGATCAAA |
| 182 | 2906 | 938 | DIRVTQSPSSLSASVGDRVTITCQASQGISDSLNWYQQKPGKAPKLLIYGAS KLEPGVSSRFSGRGSGRDFTFTISSLQPEDIGTYYCQQYDNLPLTFGPGTKLEI K |
| 182 | 2907 | 939 | QASQGISDSLN |
| 182 | 2908 | 940 | CAGGCGAGTCAGGGCATTAGCGACTCTTTAAAT |
| 182 | 2909 | 941 | GASKLEP |
| 182 | 2910 | 942 | GGTGCATCCAAATTGGAACCA |
| 182 | 2911 | 943 | QQYDNLPLT |
| 182 | 2912 | 944 | CAACAGTATGATAATCTCCCTCTGACT |
| 183 | 2913 | 945 | GAGGTGCAGCTGGTGGAGACGGGGGGCGGCTTGATACAGCCGGGGGGG TCCCTGAGACTCTCCTGCGTGGCCTCCGGATTCAGCCTTAGGAACTATGC CTTAGGTTGGCTCCGCCAGGCGCCAGGGAAGGGGCTGGAGTGGGTCTCA GGTGGCTATTATGGTGATGTCTATTACACGGACTCCGTGAAGGGCCGGTT CGCCGTCTCCAGGGACAATTCCGGGGACACAGTATATCTAGAAATGGAC AACCTGAGAGTCGAAGACACGGCCGTGTATTACTGTGCGAGAATGGAGA CAGTGACCACTGATGCAGGCTCGGGATGGGACTGGTACTTCGAGGTCTG GGGCCGCGGCACCCTGGTCACTGTCTCCTCA |
| 183 | 2914 | 946 | EVQLVETGGGLIQPGGSLRLSCVASGFSLRNYALGWLRQAPGKGLEWVSG GYYGDVYYTDSVKGRFAVSRDNSGDTVYLEMDNLRVEDTAVYYCARMET VTTDAGSGWDWYFEVWGRGTLVTVSS |
| 183 | 2915 | 947 | FSLRNYALG |
| 183 | 2916 | 948 | TTCAGCCTTAGGAACTATGCCTTAGGT |
| 183 | 2917 | 949 | GGYYGDVYYTDSVKG |
| 183 | 2918 | 950 | GGTGGCTATTATGGTGATGTCTATTACACGGACTCCGTGAAGGGC |
| 183 | 2919 | 951 | ARMETVTTDAGSGWDWYFEV |
| 183 | 2920 | 952 | GCGAGAATGGAGACAGTGACCACTGATGCAGGCTCGGGATGGGACTGG TACTTCGAGGTC |
| 183 | 2921 | 953 | GAAACGACACTCACGCAGTCTCCAGCCACCCTGTCTTTGTCTCCAGGGG ATTGGGCCACCCTCTCCTGCAGGGCCAGTCAGAGTGTTGGCACCTACTTA GCCTGGTACCAACACAAACCTGGCCAGGCTCCCAGACTCCTCATTCATG ATGCATCCAACAGGGCCAGTGACATCCCATCCAGGTTCAGTGGCAGTGG GTCTGGGACAGACTTCACTCTCACCATCCGCGGCCTAGAGCCTGAAGAT TTTGCAGTTTATTACTGTCAGCAACATCGCGACTGGCGGCCGGTCACTTT CGGCGGAGGGACCAAGGTGGAAATCAAA |
| 183 | 2922 | 954 | ETTLTQSPATLSLSPGDWATLSCRASQSVGTYLAWYQHKPGQAPRLLIHDA SNRASDIPSRFSGSGSGTDFTLTIRGLEPEDFAVYYCQQHRDWRPVTFGGGT KVEIK |
| 183 | 2923 | 955 | RASQSVGTYLA |
| 183 | 2924 | 956 | AGGGCCAGTCAGAGTGTTGGCACCTACTTAGCC |
| 183 | 2925 | 957 | DASNRAS |
| 183 | 2926 | 958 | GATGCATCCAACAGGGCCAGT |
| 183 | 2927 | 959 | QQHRDWRPVT |
| 183 | 2928 | 960 | CAGCAACATCGCGACTGGCGGCCGGTCACT |
| 184 | 2929 | 961 | CAGGTCCAGCTTGTGCAGTCTGGGGCTGAGGCGAAGAAGCCTGGGGCCT CAGTGAAGGTCTCCTGCACGGCGTCTGGATACACCTTCACCAATGATATT AACTGGGTGCGCCAGGCCACTGGACAAGGGCTTGAGTGGATGGGGTGG ATGAACCCTAACAACGGTCACACAGGATATGGACAGAAGTTCGAGGAC |

TABLE 6-continued

Informal Sequence Listing

| Antibody No. | Seq. Ref. No. | SEQ ID NO. | Sequence |
|---|---|---|---|
| | | | AGAGTCACCTTGACAAGGGACTCCTCCAGAAGCACAGCCTACATGGAAC<br>TGAGCAGCCTGAGATTTGAGGACACGGCCGTGTACTATTGTGTATACAA<br>TTTTTGGAGCGATTCTTCAGTCAGTTGGGGCCGGGGAACCCTGGTCACCG<br>TCTCCTCA |
| 184 | 2930 | 962 | QVQLVQSGAEAKKPGASVKVSCTASGYTFTNDINWVRQATGQGLEWMGW<br>MNPNNGHTGYGQKFEDRVTLTRDSSRSTAYMELSSLRFEDTAVYYCVYNF<br>WSDSSVSWGRGTLVTVSS |
| 184 | 2931 | 963 | YTFTNDIN |
| 184 | 2932 | 964 | TACACCTTCACCAATGATATTAAC |
| 184 | 2933 | 965 | WMNPNNGHTGYGQKFED |
| 184 | 2934 | 966 | TGGATGAACCCTAACAACGGTCACACAGGATATGGACAGAAGTTCGAGG<br>AC |
| 184 | 2935 | 967 | VYNFWSDSSVS |
| 184 | 2936 | 968 | GTATACAATTTTTGGAGCGATTCTTCAGTCAGT |
| 184 | 2937 | 969 | CAGTCTGTCGTGACGCAGCCGCCCTCAGTGTCTGGGGCCCCAGGGCAGA<br>GTGTCGCCATCTCCTGCACTGGGAGCAGCTCCAACATCGGGCCAGCCTA<br>TGATGTACACTGGTACCAGCAGACTCCGGGAGCAGCCCCCAAACTCCTC<br>ATCTATGGTGACAGCAATCGGCCCTCAGGGGTCCCTGACCGATTCTCTAC<br>CTCCAAGTCTGGCACCTCAGCCTCCCTGGCCATCACTGGGCTCCAGGCTG<br>AGGATGAGGCTGATTATTACTGCCAGTCCTTTGACAGCAGCCTGCGTGGT<br>TATGTCTTCGGAACTGGGACCAAGGTGACCGTCCTA |
| 184 | 2938 | 970 | QSVVTQPPSVSGAPGQSVAISCTGSSSNIGPAYDVHWYQQTPGAAPKLLIYG<br>DSNRPSGVPDRFSTSKSGTSASLAITGLQAEDEADYYCQSFDSSLRGYVFGT<br>GTKVTVL |
| 184 | 2939 | 971 | TGSSSNIGPAYDVH |
| 184 | 2940 | 972 | ACTGGGAGCAGCTCCAACATCGGGCCAGCCTATGATGTACAC |
| 184 | 2941 | 973 | GDSNRPS |
| 184 | 2942 | 974 | GGTGACAGCAATCGGCCCTCA |
| 184 | 2943 | 975 | QSFDSSLRGYV |
| 184 | 2944 | 976 | CAGTCCTTTGACAGCAGCCTGCGTGGTTATGTC |
| 185 | 2945 | 977 | CAGGTCCAGCTGGTGCAGTCTGGGGCTGAGGTGAAGAAGCCTGGGGCCT<br>CAGTGAAGGTCTCCTGCAAGGCTTCTGGATACACCTTCACCAGTTATGAT<br>ATCAACTGGGTGCGACAGGCCACTGGACATGGGCTTGAGTGGATGGGAT<br>GGATGAGCCCTAACAGTGGTTACACAGGCTATGCACAGAAGTTCCAGGG<br>CAGAGTCACCATGAGCAGGAACACCTCCACAGGCACAGCCTACATGGAG<br>CTGAGCAGCCTGAGATCTGAGGACACGGCCGTGTATTACTGTGCGAGAG<br>AGGCCCGGGACCTACGAGTGGGAGCTACTAACTTTGACTACTGGGGCCA<br>GGGAACCCTGGTCACCGTCTCCTCA |
| 185 | 2946 | 978 | QVQLVQSGAEVKKPGASVKVSCKASGYTFTSYDINWVRQATGHGLEWMG<br>WMSPNSGYTGYAQKFQGRVTMSRNTSTGTAYMELSSLRSEDTAVYYCARE<br>ARDLRVGATNFDYWGQGTLVTVSS |
| 185 | 2947 | 979 | YTFTSYDIN |
| 185 | 2948 | 980 | TACACCTTCACCAGTTATGATATCAAC |
| 185 | 2949 | 981 | WMSPNSGYTGYAQKFQG |
| 185 | 2950 | 982 | TGGATGAGCCCTAACAGTGGTTACACAGGCTATGCACAGAAGTTCCAGG<br>GC |
| 185 | 2951 | 983 | AREARDLRVGATNFDY |
| 185 | 2952 | 984 | GCGAGAGAGGCCCGGGACCTACGAGTGGGAGCTACTAACTTTGACTAC |
| 185 | 2953 | 985 | CAGCCTGTGCTGACTCAGCCACCCTCAGTGTCCGTGTCCCCAGGACAGA<br>CAGCCAGCATAACCTGCTCTGGAGATAAATTGGGAGATAAATATTTC |

TABLE 6-continued

Informal Sequence Listing

| Antibody No. | Seq. Ref. No. | SEQ ID NO. | Sequence |
|---|---|---|---|
| | | | GTGGTATCAACAGAGGCCAGGCCAGTCCCCTGTAATGGTAATTTATCAA GATAGCAAGGGGCCCTCAGGGATCCCTGAGCGATTCTCTGGCTCCAACT CTGGGAACACAGCCACTCTGACCATCAGCGGGACGCAGGCTATGGATGA GGCTGACTATTACTGTCAGGCGTGGGACAGCAGCATAGATGTGGTATTC GGCGGAGGGACCAAGCTCACCGTCCTA |
| 185 | 2954 | 986 | QPVLTQPPSVSVSPGQTASITCSGDKLGDKYISWYQQRPGQSPVMVIYQDSK GPSGIPERFSGSNSGNTATLTISGTQAMDEADYYCQAWDSSIDVVFGGGTKL TVL |
| 185 | 2955 | 987 | SGDKLGDKYIS |
| 185 | 2956 | 988 | TCTGGAGATAAATTGGGAGATAAATATATTTCG |
| 185 | 2957 | 989 | QDSKGPS |
| 185 | 2958 | 990 | CAAGATAGCAAGGGGCCCTCA |
| 185 | 2959 | 991 | QAWDSSIDVV |
| 185 | 2960 | 992 | CAGGCGTGGGACAGCAGCATAGATGTGGTA |
| 186 | 2961 | 993 | CAGGTCCAGCTGGTGCAGTCTGGGCCTGAGATGAAGAAGCCTGGGTCCT CCGTGAAGGTCTCCTGCAAGCCTTCTGGAGGCACCTTCAGCAGCTACTCT GTCAGCTGGGTGCGACAGGCCCCTGGACAAGGGCTTGAGTGGATGGGAG GAATCATCCCGATATTTGGTTCGTCAGACTACGCACAGAAGTTTCAGGG CAGACTCACAATTACAGAGGACGAATCCACGAAGACATCCTACATGCAG CTGAACAACCTGACATCTGACGACACGGCCATTTATTTCTGTGCGAGAG ACAACTACTATGTTTGGACTGGTCACTATCCCGAATTTGACTTCTGGGGC CAGGGAACCCTGGTCACCGTCTCCTCA |
| 186 | 2962 | 994 | QVQLVQSGPEMKKPGSSVKVSCKPSGGTFSSYSVSWVRQAPGQGLEWMGG IIPIFGSSDYAQKFQGRLTITEDESTKTSYMQLNNLTSDDTAIYFCARDNYYV WTGHYPEFDFWGQGTLVTVSS |
| 186 | 2963 | 995 | GTFSSYSVS |
| 186 | 2964 | 996 | GGCACCTTCAGCAGCTACTCTGTCAGC |
| 186 | 2965 | 997 | GIIPIFGSSDYAQKFQG |
| 186 | 2966 | 998 | GGAATCATCCCGATATTTGGTTCGTCAGACTACGCACAGAAGTTTCAGG GC |
| 186 | 2967 | 999 | ARDNYYVWTGHYPEFDF |
| 186 | 2968 | 1000 | GCGAGAGACAACTACTATGTTTGGACTGGTCACTATCCCGAATTTGACTT C |
| 186 | 2969 | 1001 | GAAACGACACTCACGCAGTCTCCAGGCACCCTGTCCTTGTCTCTAGGGG AGACTGCCACCCTCTCCTGCAGGGCCAGTCAGAGTGTGAGAAGCGATTA CTTAGCCTGGTACCAACAGAAACCAGGCCAGGCTCCCAGGCTCCTCATC TCTGGTGCATCCAACAGGGCCACTGCCATCCCAGAGAGGTTCACTGGCA GTGGGTCTGGGACAGACTTCACTCTCACCATCAGCAGCCTGGAGCCTGC AGATTTTGCAGTGTATTATTGTCAGCAGTATGGTAGCACACCGATCACCT TCGGCCAGGGGACACGACTGGAGATTAAA |
| 186 | 2970 | 1002 | ETTLTQSPGTLSLSLGETATLSCRASQSVRSDYLAWYQQKPGQAPRLLISGA SNRATAIPERFTGSGSGTDFTLTISSLEPADFAVYYCQQYGSTPITFGQGTRLE IK |
| 186 | 2971 | 1003 | RASQSVRSDYLA |
| 186 | 2972 | 1004 | AGGGCCAGTCAGAGTGTGAGAAGCGATTACTTAGCC |
| 186 | 2973 | 1005 | GASNRAT |
| 186 | 2974 | 1006 | GGTGCATCCAACAGGGCCACT |
| 186 | 2975 | 1007 | QQYGSTPIT |
| 186 | 2976 | 1008 | CAGCAGTATGGTAGCACACCGATCACC |
| 187 | 2977 | 1009 | CAGGTGCAGCTGCAGGAGTCGGGGGGAGGCTTGGTACAGCCTGGGGGG |

TABLE 6-continued

Informal Sequence Listing

| Antibody No. | Seq. Ref. No. | SEQ ID NO. | Sequence |
|---|---|---|---|
| | | | TCCCTGAGACTCTCCTGTTCAGCCTCTGGATTCACCTTTAGTAACTATGG<br>CATGAGTTGGGTCCGCCAGGCTCCAGGGAAGGGGCTGGAGTGGGTCTCA<br>GGTATTGGTGTGAGTGATGGAAGCACACACTACGCGGACTCCGTGAAGG<br>GCCGGTTCATCATCTCCAGAGACAATTCCAAGAACATGCTGTCTCTGCAA<br>ATGAGCAGCCTGGGAGTCGACGACACGGCCGTATATTACTGTGCGAGAA<br>TTGTAATTGTTGGAGTATTACGATTTCAGGAGTGGTTATCATCTGACGGG<br>ATGGACGTCTGGGGCCAAGGGACCACGGTCACCGTCTCCTCA |
| 187 | 2978 | 1010 | QVQLQESGGGLVQPGGSLRLSCSASGFTFSNYGMSWVRQAPGKGLEWVSG<br>IGVSDGSTHYADSVKGRFIISRDNSKNMLSLQMSSLGVDDTAVYYCARIVIV<br>GVLRFQEWLSSDGMDVWGQGTTVTSS |
| 187 | 2979 | 1011 | FTFSNYGMS |
| 187 | 2980 | 1012 | TTCACCTTTAGTAACTATGGCATGAGT |
| 187 | 2981 | 1013 | GIGVSDGSTHYADSVKG |
| 187 | 2982 | 1014 | GGTATTGGTGTGAGTGATGGAAGCACACACTACGCGGACTCCGTGAAGG<br>GC |
| 187 | 2983 | 1015 | ARIVIVGVLRFQEWLSSDGMDV |
| 187 | 2984 | 1016 | GCGAGAATTGTAATTGTTGGAGTATTACGATTTCAGGAGTGGTTATCATC<br>TGACGGGATGGACGTC |
| 187 | 2985 | 1017 | GATATTGTGATGACCCAGACTCCATCTTCCGTGTCTGCATCTGTAGGAGA<br>CAGAGTCACGATCACTTGTCGGGCGAGTCAGGCCATTAGTGGCGGGTTA<br>GCCTGGTATCAGCAGAAAGCAGGAAAAGCCCCTAAACTCCTGATCTATG<br>CTGCATCCAATTTGCCAAGTGGGGTCCCATCAAGGTTCAGCGGCAGTGG<br>ATCTGGGACAGATTTCACTCTCACCATCAGCAGCCTGCAGCCTGAGGATT<br>TTGCGACTTATTATTGTCAACAGGCTAACAGTTTCCCCTTCACCTTCGGC<br>CAAGGGACACGACTGGAGATTAAA |
| 187 | 2986 | 1018 | DIVMTQTPSSVSASVGDRVTITCRASQAISGGLAWYQQKAGKAPKLLIYAAS<br>NLPSGVPSRFSGSGSGTDFTLTISSLQPEDFATYYCQQANSFPFTFGQGTRLEI<br>K |
| 187 | 2987 | 1019 | RASQAISGGLA |
| 187 | 2988 | 1020 | CGGGCGAGTCAGGCCATTAGTGGCGGGTTAGCC |
| 187 | 2989 | 1021 | AASNLPS |
| 187 | 2990 | 1022 | GCTGCATCCAATTTGCCAAGT |
| 187 | 2991 | 1023 | QQANSFPFT |
| 187 | 2992 | 1024 | CAACAGGCTAACAGTTTCCCCTTCACC |
| 188 | 2993 | 1025 | GAGGTGCAGCTGTTGGAGTCTGGGGGAGGCCTGGTCAAGCCTGGGGGGT<br>CCCTGAGACTCTCCTGTGCAGCCTCGGATTCACCATCGGTGGTTATAAC<br>ATGTTCTGGGTCCGCCAGCCTCCGGGGAAGGGGCTGGAGTGGGTCTCAT<br>CCATTACTGCTGGTAGTAGTTATTTAAACTATGCAGACTCAGTGAAGGGC<br>CGTTTCATCGTCTCCAGAGACAACGCCAAGAATTCACTGTATCTGCAAAT<br>GAACAGCCTGAGAGCCGAGGACACGGCTGTTTATTTCTGTGCGAGAGCA<br>CCTCTTTTACCCGCTATGATGGACCTCTGGGGCCAAGGGACCACGGTCAC<br>CGTCTCCTCA |
| 188 | 2994 | 1026 | EVQLLESGGGLVKPGGSLRLSCAASGFTIGGYNMFWVRQPPGKGLEWVSSI<br>TAGSSYLNYADSVKGRFIVSRDNAKNSLYLQMNSLRAEDTAVYFCARAPLL<br>PAMMDLWGQGTTVTSS |
| 188 | 2995 | 1027 | FTIGGYNMF |
| 188 | 2996 | 1028 | TTCACCATCGGTGGTTATAACATGTTC |
| 188 | 2997 | 1029 | SITAGSSYLNYADSVKG |
| 188 | 2998 | 1030 | TCCATTACTGCTGGTAGTAGTTATTTAAACTATGCAGACTCAGTGAAGGG<br>C |
| 188 | 2999 | 1031 | ARAPLLPAMMDL |

TABLE 6-continued

Informal Sequence Listing

| Antibody No. | Seq. Ref. No. | SEQ ID NO. | Sequence |
|---|---|---|---|
| 188 | 3000 | 1032 | GCGAGAGCACCTCTTTTACCCGCTATGATGGACCTC |
| 188 | 3001 | 1033 | CAGTCTGTGGTGACGCAGCCGCCCTCAGTGTCTGGGGCCCCAGGGCAGA<br>GGGTCACCATCTCCTGCACTGGGAGCAGCTCCAACATCGGGGCAGGTTA<br>TGATGTACACTGGTACCAGCAACTTCCAGGAACAGCCCCCAAACTCCTC<br>ATCTATACTAACAACAATCGGCCCTCAGGGGTCCCTGACCGATTCTCTGG<br>CTCCAAGTCTGGCACCTCAGCCTCCCTGGCCATCACTGGGCTCCAGGCTG<br>AGGATGAGGCTGACTATTACTGCCAGTCCTATGACAGAAGCCTGAATGG<br>TTATGTCTTCGGAACTGGCACCCAGCTGACCGTCCTC |
| 188 | 3002 | 1034 | QSVVTQPPSVSGAPGQRVTISCTGSSSNIGAGYDVHWYQQLPGTAPKLLIYT<br>NNNRPSGVPDRFSGSKSGTSASLAITGLQAEDEADYYCQSYDRSLNGYVFG<br>TGTQLTVL |
| 188 | 3003 | 1035 | TGSSSNIGAGYDVH |
| 188 | 3004 | 1036 | ACTGGGAGCAGCTCCAACATCGGGGCAGGTTATGATGTACAC |
| 188 | 3005 | 1037 | TNNNRPS |
| 188 | 3006 | 1038 | ACTAACAACAATCGGCCCTCA |
| 188 | 3007 | 1039 | QSYDRSLNGYV |
| 188 | 3008 | 1040 | CAGTCCTATGACAGAAGCCTGAATGGTTATGTC |
| 189 | 3009 | 1041 | CAGGTCCAGCTTGTACAGTCTGGGGGAGGCTTGGTCAAGGCTGGAGGGT<br>CCCTGAGACTCTCCTGTGCAGCCTCTGGATTCACCATCAGTGGCTTCTAC<br>ATGACCTGGATCCGCCAGGCTCCAGGGAAGGGGCTGGAGTGGGTTTCAT<br>CCATTAGTGGTAGTAGTAGTTACACAAACTACGCAGACTCTGTGAAGGG<br>CCGATTCACCATCTCCAGAGACAACGCCAAGAACTCACTGTATCTGCAC<br>ATGAACAGCCTGAGAGCCGAGGACACGGCTGTATATTACTGTGCGAGAA<br>TAAGGCCGGATGATAGTAGTGGTTATCCTGACTACTGGGGCCAGGGAAC<br>CCTGGTCACCGTCTCCTCA |
| 189 | 3010 | 1042 | QVQLVQSGGGLVKAGGSLRLSCAASGFTISGFYMTWIRQAPGKGLEWVSSI<br>SGSSSYTNYADSVKGRFTISRDNAKNSLYLHMNSLRAEDTAVYYCARIRPD<br>DSSGYPDYWGQGTLVTVSS |
| 189 | 3011 | 1043 | FTISGFYMT |
| 189 | 3012 | 1044 | TTCACCATCAGTGGCTTCTACATGACC |
| 189 | 3013 | 1045 | SISGSSSYTNYADSVKG |
| 189 | 3014 | 1046 | TCCATTAGTGGTAGTAGTAGTTACACAAACTACGCAGACTCTGTGAAGG<br>GC |
| 189 | 3015 | 1047 | ARIRPDDSSGYPDY |
| 189 | 3016 | 1048 | GCGAGAATAAGGCCGGATGATAGTAGTGGTTATCCTGACTAC |
| 189 | 3017 | 1049 | CAGTCTGTGTTGACGCAGCCGCCCTCAGTGTCTGGGGCCCCAGGGCAGA<br>GGGTCACCATCTCCTGCACTGGGAGCAGCTCCAACATCGGGGCTGGTTA<br>TGATGTACACTGGTGCCAGCAGCTTCCAGGAACAGCCCCCAAACTCCTC<br>ATCTATGGTAACAACAATCGGCCCTCAGGGGTCCCTGACCGATTCTCTGG<br>CTCCAAGTCTGGCACCTCAGCCTCCCTGGCCATCACTGGGCTCCAGGCTG<br>AGGATGAGGCTGATTATTACTGCCAGTCCTATGACAGCAGCCTGAGTGG<br>CTTTGTCTTCGGAACTGGGACCAAGGTGACCGTCCTA |
| 189 | 3018 | 1050 | QSVLTQPPSVSGAPGQRVTISCTGSSSNIGAGYDVHWCQQLPGTAPKLLIYG<br>NNNRPSGVPDRFSGSKSGTSASLAITGLQAEDEADYYCQSYDSSLSGFVFGT<br>GTKVTVL |
| 189 | 3019 | 1051 | TGSSSNIGAGYDVH |
| 189 | 3020 | 1052 | ACTGGGAGCAGCTCCAACATCGGGGCTGGTTATGATGTACAC |
| 189 | 3021 | 1053 | GNNNRPS |
| 189 | 3022 | 1054 | GGTAACAACAATCGGCCCTCA |
| 189 | 3023 | 1055 | QSYDSSLSGFV |

TABLE 6-continued

Informal Sequence Listing

| Antibody No. | Seq. Ref. No. | SEQ ID NO. | Sequence |
|---|---|---|---|
| 189 | 3024 | 1056 | CAGTCCTATGACAGCAGCCTGAGTGGCTTTGTC |
| 190 | 3025 | 1057 | GAGGTGCAGCTGGTGGAGTCTGGGGCTGAGGTGAGGAAGCCTGGGGCCT<br>CAGTGCAGGTTTCCTGCAAGGCATCTGGATACACCTTCACCAGCTACTAT<br>ATGCACTGGGTGCGACAGGCCCCTGGACACGGGCTTGAGTGGATGGGAA<br>TGATCTACCCTAGTGGTGGTAGCACAAGCTACGCACAGAAGTTCCAGGG<br>CAGAGTCACCATGACCAGGGACACGTCCACGAGCACAGTCTACATGGAG<br>CTGAGCAGCCTGAGATCTGAGGACGCGGCCGTGTATTACTGTGCGAGAG<br>ACCGGGCAGGGTGTAGTGGTGGTAGCTGTTACTATTATGGTATGGACGT<br>CTGGGGCCAAGGGACCACGGTCACCGTCTCCTCA |
| 190 | 3026 | 1058 | EVQLVESGAEVRKPGASVQVSCKASGYTFTSYYMHWVRQAPGHGLEWMG<br>MIYPSGGSTSYAQKFQGRVTMTRDTSTSTVYMELSSLRSEDAAVYYCARDR<br>AGCSGGSCYYYGMDVWGQGTTVTVSS |
| 190 | 3027 | 1059 | YTFTSYYMH |
| 190 | 3028 | 1060 | TACACCTTCACCAGCTACTATATGCAC |
| 190 | 3029 | 1061 | MIYPSGGSTSYAQKFQG |
| 190 | 3030 | 1062 | ATGATCTACCCTAGTGGTGGTAGCACAAGCTACGCACAGAAGTTCCAGG<br>GC |
| 190 | 3031 | 1063 | ARDRAGCSGGSCYYYGMDV |
| 190 | 3032 | 1064 | GCGAGAGACCGGGCAGGGTGTAGTGGTGGTAGCTGTTACTATTATGGTA<br>TGGACGTC |
| 190 | 3033 | 1065 | AATTTTATGCTGACTCAGCCCCCCTCAGTGTCCGTGTCCCCAGGACAGAC<br>AGCCAGCATCACCTGCTCTGGAAATAAATTGGGGGATAAATATGCTTGC<br>TGGTATCAACAAAAGCCAGGCCAGTCCCCTGTGCTGGTCATCTCTCAAG<br>ATAGCAAGCGGCCCTCAGGGATCCCTGAGCGATTCTCTGGCTCCAACTCT<br>GGGAACACAGCCACTCTGACCATCAGCGGGACCCAGGCTATGGATGAGG<br>CTGACTATTACTGTCAGGCGTGGGACAGTAGAACTGTTGTATTCGGCGG<br>AGGGACCAAGCTGACCGTCCTA |
| 190 | 3034 | 1066 | NFMLTQPPSVSVSPGQTASITCSGNKLGDKYACWYQQKPGQSPVLVISQDS<br>KRPSGIPERFSGSNSGNTATLTISGTQAMDEADYYCQAWDSRTVVFGGGTK<br>LTVL |
| 190 | 3035 | 1067 | SGNKLGDKYAC |
| 190 | 3036 | 1068 | TCTGGAAATAAATTGGGGGATAAATATGCTTGC |
| 190 | 3037 | 1069 | QDSKRPS |
| 190 | 3038 | 1070 | CAAGATAGCAAGCGGCCCTCA |
| 190 | 3039 | 1071 | QAWDSRTVV |
| 190 | 3040 | 1072 | CAGGCGTGGGACAGTAGAACTGTTGTA |
| 191 | 3041 | 1073 | GAGGTGCAGCTGGTGGAGTCTGGGGCTGAGGTGAAGAAGCCTGGGTCCT<br>CGGTGAAGGTCTCCTGCAAGGCTTCTGGAGGCACCTTCAGTAGTTATGA<br>AATCAGCTGGGTGCGACAGGCCCCTGGACAAGGACTTGAGTGGATGGGA<br>GGGATCAACCCTATGTTTGGAGCAGCAAACTACGCACAGAAGTTCCAGG<br>ACAGAGTCACGATTATCGCGGACAAATCCACGGGCACAGTCTACATGGA<br>ACTGAGCAGCCTGAGATCTGAGGACACGGCCCTCTATTACTGTGCGAGA<br>GAACGCTACCCGTCTACGGATGACTATTATAGGAGTGGTCGTTACTACG<br>GGGAGTGGGGCCAGGGGACCACGGTCACCGTCTCCTCA |
| 191 | 3042 | 1074 | EVQLVESGAEVKKPGSSVKVSCKASGGTFSSYEISWVRQAPGQGLEWMGGI<br>NPMFGAANYAQKFQDRVTIIADKSTGTVYMELSSLRSEDTALYYCARERYP<br>STDDYYRSGRYYGEWGQGTTVTVSS |
| 191 | 3043 | 1075 | GTFSSYEIS |
| 191 | 3044 | 1076 | GGCACCTTCAGTAGTTATGAAATCAGC |
| 191 | 3045 | 1077 | GINPMFGAANYAQKFQD |
| 191 | 3046 | 1078 | GGGATCAACCCTATGTTTGGAGCAGCAAACTACGCACAGAAGTTCCAGG<br>AC |

TABLE 6-continued

Informal Sequence Listing

| Antibody No. | Seq. Ref. No. | SEQ ID NO. | Sequence |
|---|---|---|---|
| 191 | 3047 | 1079 | ARERYPSTDDYYRSGRYYGE |
| 191 | 3048 | 1080 | GCGAGAGAACGCTACCCGTCTACGGATGACTATTATAGGAGTGGTCGTT<br>ACTACGGGGAG |
| 191 | 3049 | 1081 | GAAACGACACTCACGCAGTCTCCTTCCACCCTGTCTGCATCTGTAGGAGA<br>CAGAGTCACCATCACTTGCCGGGCCAGTCAGAGTATTCGTAGTTGGTTG<br>GCCTGGTATCAGCAGAAACCAGGGAAAGCCCCGAAGCTCCTGATCTATA<br>GGGCGTCTACTTCAGACAGTGGGGTCCCATCAAGGTTCAGCGGCAGTGG<br>ATCTGGGACAGAATTCACGCTCACCATCAGCAGCCTGCAGCCTGATGAT<br>TTTGCAATTTATTACTGCCAACAGTATAATAGCATCCCAGTGACGTTCGG<br>CCAAGGGACCAAGCTGGAGATCAAA |
| 191 | 3050 | 1082 | ETTLTQSPSTLSASVGDRVTITCRASQSIRSWLAWYQQKPGKAPKLLIYRAS<br>TSDSGVPSRFSGSGSGTEFTLTISSLQPDDFAIYYCQQYNSIPVTFGQGTKLEI<br>K |
| 191 | 3051 | 1083 | RASQSIRSWLA |
| 191 | 3052 | 1084 | CGGGCCAGTCAGAGTATTCGTAGTTGGTTGGCC |
| 191 | 3053 | 1085 | RASTSDS |
| 191 | 3054 | 1086 | AGGGCGTCTACTTCAGACAGT |
| 191 | 3055 | 1087 | QQYNSIPVT |
| 191 | 3056 | 1088 | CAACAGTATAATAGCATCCCAGTGACG |
| 192 | 3057 | 1089 | GAGGTGCAGCTGGTGGAGTCTGGGGGAGGCGTGGTCCAGCCTGGGAGGT<br>CCCTGAGACTCTCCTGTGCAGCGTCTGGATTCACATTCAGTGACTATGCC<br>ATGCACTGGGTCCGCCAGGCTCCAGGCAAGGGGCTGGAGTGGGTGGCAG<br>TTATATGGTATGATGGAGGTAATAAATACTATGCAGACTCCGCGAAGGG<br>CCGATTCACCATCTCCAGAGACAATTCCAAGAACACGCTGTATCTGCAA<br>ATGAACAGCCTGAGAGCCGAGGACACGGCTGTGTATTACTGTGCGAAAG<br>ATCGCGGGTCTATCTGGAACGTTGGGGATGGTATGGACGTCTGGGGCCA<br>AGGGACCACGGTCACCGTCTCTTCA |
| 192 | 3058 | 1090 | EVQLVESGGGVVQPGRSLRLSCAASGFTFSDYAMHWVRQAPGKGLEWVA<br>VIWYDGGNKYYADSAKGRFTISRDNSKNTLYLQMNSLRAEDTAVYYCAKD<br>RGSIWNVGDGMDVWGQGTTVTVSS |
| 192 | 3059 | 1091 | FTFSDYAMH |
| 192 | 3060 | 1092 | TTCACATTCAGTGACTATGCCATGCAC |
| 192 | 3061 | 1093 | VIWYDGGNKYYADSAKG |
| 192 | 3062 | 1094 | GTTATATGGTATGATGGAGGTAATAAATACTATGCAGACTCCGCGAAGG<br>GC |
| 192 | 3063 | 1095 | AKDRGSIWNVGDGMDV |
| 192 | 3064 | 1096 | GCGAAAGATCGCGGGTCTATCTGGAACGTTGGGGATGGTATGGACGTC |
| 192 | 3065 | 1097 | CAGCCTGTGCTGACTCAGCCACCCTCGGTGTCAGTGGCCCCAGGACAGA<br>CGGCCAGGGTTACCTGTGGGGGAAACAACATTGGAGCTAAGAGTGTCCA<br>CTGGTACCAGCAGAAGCCAGGCCAGGCCCCTGTGCTGGTCGTCGATGAT<br>GATACCGACCGGCCCTCAGGGATCCCTGAGCGATTCTCTGGCTCCAACTC<br>TGGGAACACGGCCACCCTGACCATCAGCAGGGTCGAAGCCGGGGATGA<br>GGCCGACTATTACTGTCAGGTGTGGGATGCTAGTATTGGTCCTCTTTATG<br>TCTTCGGAACTGGGACCAAGCTCACCGTCCTA |
| 192 | 3066 | 1098 | QPVLTQPPSVSVAPGQTARVTCGGNNIGAKSVHWYQQKPGQAPVLVVDDD<br>TDRPSGIPERFSGSNSGNTATLTISRVEAGDEADYYCQVWDASIGPLYVFGT<br>GTKLTVL |
| 192 | 3067 | 1099 | GGNNIGAKSVH |
| 192 | 3068 | 1100 | GGGGGAAACAACATTGGAGCTAAGAGTGTCCAC |
| 192 | 3069 | 1101 | DDTDRPS |

TABLE 6-continued

Informal Sequence Listing

| Antibody No. | Seq. Ref. No. | SEQ ID NO. | Sequence |
|---|---|---|---|
| 192 | 3070 | 1102 | GATGATACCGACCGGCCCTCA |
| 192 | 3071 | 1103 | QVWDASIGPLYV |
| 192 | 3072 | 1104 | CAGGTGTGGGATGCTAGTATTGGTCCTCTTTATGTC |
| 193 | 3073 | 1105 | CAGGTCCAGCTGGTGCAGTCTGGGGGAGGCGTGGTCCAGCCTGGGAGGT<br>CCCTGAGACTCTCCTGTGCAGCCTCTGGTTTCACCTTCAGTGACTTTTCTA<br>TGCACTGGGTCCGCCAGGCTCCAGGCAAGGGGCTGGAGTGGGTGGCACT<br>CATCTCAAATGATGGAAGCAATAAATATTATTCAGACTCCCTGAAGGGT<br>TCATTCATCATCTCCAGAGACAACTCCAAGAACACGCTCTATCTCCAACT<br>GAACAGCCTGGGAGCTGAGGACACGGCTCTGTATTACTGTGCGAGAGAT<br>GCGGTTCCCCATTATGATTACGTCTGGGGAAACTTTGACTACTGGGGCCC<br>GGGAACCCTGGTCACCGTCTCCTCA |
| 193 | 3074 | 1106 | QVQLVQSGGGVVQPGRSLRLSCAASGFTFSDFSMHWVRQAPGKGLEWVAL<br>ISNDGSNKYYSDSLKGSFIISRDNSKNTLYLQLNSLGAEDTALYYCARDAVP<br>HYDYVWGNFDYWGPGTLVTVSS |
| 193 | 3075 | 1107 | FTFSDFSMH |
| 193 | 3076 | 1108 | TTCACCTTCAGTGACTTTTCTATGCAC |
| 193 | 3077 | 1109 | LISNDGSNKYYSDSLKG |
| 193 | 3078 | 1110 | CTCATCTCAAATGATGGAAGCAATAAATATTATTCAGACTCCCTGAAGG<br>GT |
| 193 | 3079 | 1111 | ARDAVPHYDYVWGNFDY |
| 193 | 3080 | 1112 | GCGAGAGATGCGGTTCCCCATTATGATTACGTCTGGGGAAACTTTGACT<br>AC |
| 193 | 3081 | 1113 | CAGCCTGTGCTGACTCAGCCTGCCTCCGTGTCTGCGTCTCCTGGACAGTC<br>GATCACCATCTCCTGCACTGGAACCAGCAGTGACGTTGGTGGTTATAATT<br>ATGTCTCCTGGTACCAACAGCACCCAGGCAAAGCCCCCAAACTCATAGT<br>TTATGAGGTCAGTAATCGGCCCTCAGGGGTTTCTAATCGCTTCTCTGGCT<br>CCAAGTCTGGCAACACGGCCTCCTGACCATCTCTGGGCTCCAGGCTGA<br>CGACGAGGCTGATTATTACTGCAGCTCATATACAAGTTTCACTCCCGTGG<br>TATTCGGCGGAGGGACCAAGGTGACCGTCCTA |
| 193 | 3082 | 1114 | QPVLTQPASVSASPGQSITISCTGTSSDVGGYNYVSWYQQHPGKAPKLIVYE<br>VSNRPSGVSNRFSGSKSGNTASLTISGLQADDEADYYCSSYTSFTPVVFGGG<br>TKVTVL |
| 193 | 3083 | 1115 | TGTSSDVGGYNYVS |
| 193 | 3084 | 1116 | ACTGGAACCAGCAGTGACGTTGGTGGTTATAATTATGTCTCC |
| 193 | 3085 | 1117 | EVSNRPS |
| 193 | 3086 | 1118 | GAGGTCAGTAATCGGCCCTCA |
| 193 | 3087 | 1119 | SSYTSFTPVV |
| 193 | 3088 | 1120 | AGCTCATATACAAGTTTCACTCCCGTGGTA |
| 194 | 3089 | 1121 | GAGGTGCAGCTGGTGGAGTCTGGGGGAGGCTTGGTCAGCCTGGGGGGT<br>CCCTGAGACTCTCCTGTGCAGCCTCTGGATTCACTTTTAGCGACTTTGCC<br>ATGAGCTGGGTCCGCCAGGCTCCAGGGAAGGGGCTGGAGTGGGTCTCAC<br>TTATTAAAAGTAGTGATTATGCATACTATGCAGACTCCGTGAGGGGCCG<br>GTTCACCATCTCCAGAGACAATTCCAAGAACACCCTGTATCTGCAATG<br>AACAGCCTGAGAGCCGACGACACGGCCGTATATTACTGTGCGAAAGACG<br>CCGATTTTTGGAGTGGTGATTCCTACAATGGAGGGTACAACTTTGACTCC<br>TGGGGCCAGGGAACCCTGGTCACCGTCTCCTCA |
| 194 | 3090 | 1122 | EVQLVESGGGLVQPGGSLRLSCAASGFTFSDFAMSWVRQAPGKGLEWVSLI<br>KSSDYAYYADSVRGRFTISRDNSKNTLYLRMNSLRADDTAVYYCAKDADF<br>WSGDSYNGGYNFDSWGQGTLVTVSS |
| 194 | 3091 | 1123 | FTFSDFAMS |
| 194 | 3092 | 1124 | TTCACTTTTAGCGACTTTGCCATGAGC |

TABLE 6-continued

Informal Sequence Listing

| Antibody No. | Seq. Ref. No. | SEQ ID NO. | Sequence |
|---|---|---|---|
| 194 | 3093 | 1125 | LIKSSDYAYYADSVRG |
| 194 | 3094 | 1126 | CTTATTAAAAGTAGTGATTATGCATACTATGCAGACTCCGTGAGGGGC |
| 194 | 3095 | 1127 | AKDADFWSGDSYNGGYNFDS |
| 194 | 3096 | 1128 | GCGAAAGACGCCGATTTTTGGAGTGGTGATTCCTACAATGGAGGGTACA ACTTTGACTCC |
| 194 | 3097 | 1129 | GATATTGTGCTGACCCAGTCTCCAGCCACCCTGTCTGTATCTCCAGGGGA AAGAGCCACCCTCTCCTGCAGGGCCAGTCAGAGTGTTGGCACCAACTTG GCCTGGTACCAGCAAAAACCTGGCCAGGCTCCCCGGCTCCTCATCTTTGG TGCCTCAACCAGGGCCACTGGTATCCCAGCCAGGTTCAGTGGCAGTGGG TCTGGGACAGAGTTCACTCTCACCATCAGCAGCCTGCAGTCTGAAGATTT TGCAGTTTATTACTGTCAGCAGTATAATAAGTGGCCTCCGCTCACTTTCG GCGGAGGGACCAAAGTGGATATCAAA |
| 194 | 3098 | 1130 | DIVLTQSPATLSVSPGERATLSCRASQSVGTNLAWYQQKPGQAPRLLIFGAS TRATGIPARFSGSGSGTEFTLTISSLQSEDFAVYYCQQYNKWPPLTFGGGTK VDIK |
| 194 | 3099 | 1131 | RASQSVGTNLA |
| 194 | 3100 | 1132 | AGGGCCAGTCAGAGTGTTGGCACCAACTTGGCC |
| 194 | 3101 | 1133 | GASTRAT |
| 194 | 3102 | 1134 | GGTGCCTCAACCAGGGCCACT |
| 194 | 3103 | 1135 | QQYNKWPPLT |
| 194 | 3104 | 1136 | CAGCAGTATAATAAGTGGCCTCCGCTCACT |
| 195 | 3105 | 1137 | CAGGTCCAGCTTGTGCAGTCTGGGGGAGGCTTGGTCAAGCCTGGAGGGT CCCTGAGACTCTCCTGTGCAGCCTCTGGATTCATCTTCAGTGACTACTAC ATGGTCTGGATCCGTCAGGCTCCAGGGAAGGGGCTGGAGTGGGTTTCAT ACATTAGTAGTAGCAGCAGATACATAAACTACGCAGACTCTGTGAAGGG CCGATTCACCATCTCCAGAGACAACGCCAAGAACTCACTGTTTCTGCAA ATGAACACCGTGAGAGCCGAGGACACGGCTGTGTATTACTGTGCGCAAG GCTGGTATTCCGATTTTTGGAGTGGTCCCATTAGGATTTGGGGCCAGGGA ACCCTGGTCACCGTCTCCTCA |
| 195 | 3106 | 1138 | QVQLVQSGGGLVKPGGSLRLSCAASGFIFSDYYMVWIRQAPGKGLEWVSYI SSSSRYINYADSVKGRFTISRDNAKNSLFLQMNTVRAEDTAVYYCAQGWYS DFWSGPIRIWGQGTLVTSS |
| 195 | 3107 | 1139 | FIFSDYYMV |
| 195 | 3108 | 1140 | TTCATCTTCAGTGACTACTACATGGTC |
| 195 | 3109 | 1141 | YISSSSRYINYADSVKG |
| 195 | 3110 | 1142 | TACATTAGTAGTAGCAGCAGATACATAAACTACGCAGACTCTGTGAAGG GC |
| 195 | 3111 | 1143 | AQGWYSDFWSGPIRI |
| 195 | 3112 | 1144 | GCGCAAGGCTGGTATTCCGATTTTTGGAGTGGTCCCATTAGGATT |
| 195 | 3113 | 1145 | GACATCCAGTTGACCCAGTCTCCATCCTCCCTGTCTGCATCTGTAGGAGA CAGAGTCACCATCACTTGCCAGGCGAGTCAGGACATTAGTAACTCTTTA AATTGGTTTCAGCAGAAACCTGGGAAAGCCCCTAAGCTCCTGATCTTCG ATGCATACAATCTGGAAACAGGGGTCCCATCAAGGTTCAGTGGAAGTGG ATCTGGGACAGATTTTACCCTCACCATCAGCAGCCTGCAGCCTGAAGAT ATTGCAACATATTACTGTCAGCAGAATGATAATCTCGTTCTCACTTTCGG CGGAGGGACCAAGCTGGAGATCAAA |
| 195 | 3114 | 1146 | DIQLTQSPSSLSASVGDRVTITCQASQDISNSLNWFQQKPGKAPKLLIFDAYN LETGVPSRFSGSGSGTDFTLTISSLQPEDIATYYCQQNDNLVLTFGGGTKLEI K |
| 195 | 3115 | 1147 | QASQDISNSLN |
| 195 | 3116 | 1148 | CAGGCGAGTCAGGACATTAGTAACTCTTTAAAT |

TABLE 6-continued

Informal Sequence Listing

| Antibody No. | Seq. Ref. No. | SEQ ID NO. | Sequence |
|---|---|---|---|
| 195 | 3117 | 1149 | DAYNLET |
| 195 | 3118 | 1150 | GATGCATACAATCTGGAAACA |
| 195 | 3119 | 1151 | QQNDNLVLT |
| 195 | 3120 | 1152 | CAGCAGAATGATAATCTCGTTCTCACT |
| 196 | 3121 | 1153 | CAGGTGCAGCTGGTGGAGTCTGGGGGAGGCTTGGTACAGCCTGGCAGGT CCCTGAGACTCTCCTGTGCAGCCTCTGGATTCACGTTTGATAATTACCCC ATGCACTGGATCCGGCAAGCTCCAGGGAAGGGCCTGGAGTGGGTCTCAG GTATTAGTTGGCATAGTGGAAGCATAGGCTATGCGGACTCTGTGAAGGG CCGATTCACCATCTCCAGAGACAACGCCAAGAACTCCCTGTATCTGCAA ATGAACAGTCTGAGAACTGAGGACACGGCCTTGTATTACTGTGCAAAAG ACGCCCATTACTTTGATAATAGCGGTCACTACTACTACGGTCTGGACGTC TGGGGCCAAGGGACCACGGTCACCGTCTCCTCA |
| 196 | 3122 | 1154 | QVQLVESGGGLVQPGRSLRLSCAASGFTFDNYPMHWIRQAPGKGLEWVSGI SWHSGSIGYADSVKGRFTISRDNAKNSLYLQMNSLRTEDTALYYCAKDAH YFDNSGHYYYGLDVWGQGTTVTVSS |
| 196 | 3123 | 1155 | FTFDNYPMH |
| 196 | 3124 | 1156 | TTCACGTTTGATAATTACCCCATGCAC |
| 196 | 3125 | 1157 | GISWHSGSIGYADSVKG |
| 196 | 3126 | 1158 | GGTATTAGTTGGCATAGTGGAAGCATAGGCTATGCGGACTCTGTGAAGG GC |
| 196 | 3127 | 1159 | AKDAHYFDNSGHYYYGLDV |
| 196 | 3128 | 1160 | GCAAAAGACGCCCATTACTTTGATAATAGCGGTCACTACTACTACGGTCT GGACGTC |
| 196 | 3129 | 1161 | GAAATTGTGTTGACACAGTCTCCAGCCACCCTGTCTGTGTCTCCAGGGGA AAGAGCCACCCTCTCCTGCAGGGCCAGTCAGAATATTATCAACAACTTA GCCTGGTACCAGCAGAAACCTGGCCAGGCTCCCAGGCTCCTCATCTCTG GTGCATCCACCAGGGCCACTGGTATCCCAGCCAGGTTCAGTGGCAGTGG GTCTGGGACAGAGTTCACTCTCACCATCACCAGCCTGCAGTCTGAAGATT TTGCAGTTTATTACTGTCAGCAGTATAATAACTGGCCGCTCACTTTCGGC GGAGGGACCAAAGTGGATATCAAA |
| 196 | 3130 | 1162 | EIVLTQSPATLSVSPGERATLSCRASQNIINNLAWYQQKPGQAPRLLISGAST RATGIPARFSGSGSGTEFTLTITSLQSEDFAVYYCQQYNNWPLTFGGGTKVD IK |
| 196 | 3131 | 1163 | RASQNIINNLA |
| 196 | 3132 | 1164 | AGGGCCAGTCAGAATATTATCAACAACTTAGCC |
| 196 | 3133 | 1165 | GASTRAT |
| 196 | 3134 | 1166 | GGTGCATCCACCAGGGCCACT |
| 196 | 3135 | 1167 | QQYNNWPLT |
| 196 | 3136 | 1168 | CAGCAGTATAATAACTGGCCGCTCACT |
| 197 | 3137 | 1169 | CAGGTCCAGCTGGTGCAGTCTGGGGGAGGCTTGGTACAGCCAGGGCGGT CCCTGAGACTCTCCTGTACAGCCTCTGGATTCAGCTTCAGTGATTATGGA GTGACCTGGGTCCGCCAGGCTCCAGGGAAGGGGCTGGAGTGGATAGGTT TCGTCAGAACCAAGGGTTATGGAGGGACAACAGAGTACGCCGCGTCTGT GAGAGGCAGATTCACCATCTCAAGAGATGACTCCAAAAGCGTCGCCTAT CTACAATTGAACAGCCTGAAAGTCGAGGATACAGCCGTCTATTACTGTT CTGGGGCATCACGGGGCTTTTGGAGTGGGCCAACCTACTACTACTTTGGT ATGGACGTCTGGGGCCATGGGACCACGGTCACTGTCTCCTCA |
| 197 | 3138 | 1170 | QVQLVQSGGGLVQPGRSLRLSCTASGFSFSDYGVTWVRQAPGKGLEWIGFV RTKGYGGTTEYAASVRGRFTISRDDSKSVAYLQLNSLKVEDTAVYYCSGAS RGFWSGPTYYYFGMDVWGHGTTVTVSS |
| 197 | 3139 | 1171 | FSFSDYGVT |

TABLE 6-continued

Informal Sequence Listing

| Antibody No. | Seq. Ref. No. | SEQ ID NO. | Sequence |
|---|---|---|---|
| 197 | 3140 | 1172 | TTCAGCTTCAGTGATTATGGAGTGACC |
| 197 | 3141 | 1173 | FVRTKGYGGTTEYAASVRG |
| 197 | 3142 | 1174 | TTCGTCAGAACCAAGGGTTATGGAGGGACAACAGAGTACGCCGCGTCTG<br>TGAGAGGC |
| 197 | 3143 | 1175 | SGASRGFWSGPTYYYFGMDV |
| 197 | 3144 | 1176 | TCTGGGGCATCACGGGGCTTTTGGAGTGGGCCAACCTACTACTACTTTGG<br>TATGGACGTC |
| 197 | 3145 | 1177 | GAAATTGTGTTGACACAGTCTCCACTCTCCCTGGCCGTCACCCCTGGAGA<br>GCCGGCCTCCATCTCCTGCAGGTCTAGTCAGAGCCTCCTGCATGGTAATG<br>GATACAACTACTTGGATTGGTACCTGCAGAAGCCAGGGCAGTCTCCACA<br>ACTCCTGATCTTTTGGGGTTCTTATCGGGCCTCCGGGGCCCCTGACAGGT<br>TCAGTGCCAGTGGATCAGGCTCAGAGTTTACACTGAAAATCAGAAGAGT<br>GGAGGCTGAGGATGTGGGGTTTATTACTGCATGCAACCTCTACAAACA<br>ACTTTTGGCCAGGGGACCAAAGTGGATATCAAA |
| 197 | 3146 | 1178 | EIVLTQSPLSLAVTPGEPASISCRSSQSLLHGNGYNYLDWYLQKPGQSPQLLI<br>FWGSYRASGAPDRFSASGSGSEFTLKIRRVEAEDVGVYYCMQPLQTTFGQG<br>TKVDIK |
| 197 | 3147 | 1179 | RSSQSLLHGNGYNYLD |
| 197 | 3148 | 1180 | AGGTCTAGTCAGAGCCTCCTGCATGGTAATGGATACAACTACTTGGAT |
| 197 | 3149 | 1181 | WGSYRAS |
| 197 | 3150 | 1182 | TGGGGTTCTTATCGGGCCTCC |
| 197 | 3151 | 1183 | MQPLQTT |
| 197 | 3152 | 1184 | ATGCAACCTCTACAAACAACT |
| 198 | 3153 | 1185 | CAGGTCCAGCTGGTGCAGTCTGGAGCAGAGGTGAAAAAGCCCGGGGAG<br>TCTCTAAAGATCTCCTGTAAGGGTTCTGGATACACCTTTAGAATGTATTG<br>GATCGGCTGGGCGCGCCTGCTGCCCGGGAAAGGCCTGGAGTGGATAGGA<br>ATCATCTATCCTGGTGACTCTGATACCAGGTACAACCCGTCCCTCCAAGG<br>CCAGGTCACCATGTCAGTCGACAAGTCCATCAACACCGCCTACCTCCAG<br>TGGGGAAGCCTGAAGGCCTCGGACAGCGCCATTTATTACTGTGCGAGAC<br>TGAGATTACATCCCCAGAGTGGAATGGACGTCTGGGGCCAAGGGACCCT<br>GGTCACCGTCTCCTCA |
| 198 | 3154 | 1186 | QVQLVQSGAEVKKPGESLKISCKGSGYTFRMYWIGWARLLPGKGLEWIGII<br>YPGDSDTRYNPSLQGQVTMSVDKSINTAYLQWGSLKASDSAIYYCARLRLH<br>PQSGMDVWGQGTLVTVSS |
| 198 | 3155 | 1187 | YTFRMYWIG |
| 198 | 3156 | 1188 | TACACCTTTAGAATGTATTGGATCGGC |
| 198 | 3157 | 1189 | IIYPGDSDTRYNPSLQG |
| 198 | 3158 | 1190 | ATCATCTATCCTGGTGACTCTGATACCAGGTACAACCCGTCCCTCCAAGG<br>C |
| 198 | 3159 | 1191 | ARLRLHPQSGMDV |
| 198 | 3160 | 1192 | GCGAGACTGAGATTACATCCCCAGAGTGGAATGGACGTC |
| 198 | 3161 | 1193 | AATTTTATGCTGACTCAGCCCCACTCTGTGTCGGAGTCTCCGGGGAAGAC<br>GGTAGTTATCTCCTGCACCCGCAGCAGTGGCAGCATTGCCGGCTACTATG<br>TGCAGTGGTACCAACATCGCCCGGGCAGTTCCCCCACTACTGTGATATAT<br>GAGGATGACCAAAGACCCTCTGGGGTCCCTGATCGGTTCTCTGGGTCCG<br>TCGACAGCTCCTCCAACTCTGCCTCCCTCACCATCTCTGGACTGAAGACT<br>GAGGACGAGGCTGACTACTATTGTCAGTCCTATGATAACGCCATTTGGG<br>TGTTCGGCGGAGGGACCAAGCTCACCGTCCTA |
| 198 | 3162 | 1194 | NFMLTQPHSVSESPGKTVVISCTRSSGSIAGYYVQWYQHRPGSSPTTVIYED<br>DQRPSGVPDRFSGSVDSSSNSASLTISGLKTEDEADYYCQSYDNAIWVFGGG<br>TKLTVL |

TABLE 6-continued

Informal Sequence Listing

| Antibody No. | Seq. Ref. No. | SEQ ID NO. | Sequence |
|---|---|---|---|
| 198 | 3163 | 1195 | TRSSGSIAGYYVQ |
| 198 | 3164 | 1196 | ACCCGCAGCAGTGGCAGCATTGCCGGCTACTATGTGCAG |
| 198 | 3165 | 1197 | EDDQRPS |
| 198 | 3166 | 1198 | GAGGATGACCAAAGACCCTCT |
| 198 | 3167 | 1199 | QSYDNAIWV |
| 198 | 3168 | 1200 | CAGTCCTATGATAACGCCATTTGGGTG |
| 199 | 3169 | 1201 | CAGGTGCAGCTTGTGCAGTCTGGGGCTGAGGTGAAGAAGCCTGGGTCCT CGGTGAAGGTCTCCTGCAAGGCTTCTGGAGGCACCTTCAGCAGCTATGC TATCAGCTGGGTGCGACAGGCCCCTGGACAAGGGCTTGAGTGGATGGGA GGGATCATCCCTATCTTTGGTACAGTAAACTACGCACAGAAGTTCCAGG GCAGAGTCACGATTACCGCGGACGAATCCACGAGCACAGCCTACATGGA GCTGAGCAGTCTGAGATCTGAGGACACGGCCGTGTATTACTGTGCGAGA GATCGTTCGGTGACCCCTCGCTACTACGGTATGGACGTCTGGGGCCAAG GGACCACGGTCACCGTCTCCTCA |
| 199 | 3170 | 1202 | QVQLVQSGAEVKKPGSSVKVSCKASGGTFSSYAISWVRQAPGQGLEWMGG IIPIFGTVNYAQKFQGRVTITADESTSTAYMELSSLRSEDTAVYYCARDRSVT PRYYGMDVWGQGTTVTVSS |
| 199 | 3171 | 1203 | GTFSSYAIS |
| 199 | 3172 | 1204 | GGCACCTTCAGCAGCTATGCTATCAGC |
| 199 | 3173 | 1205 | GIIPIFGTVNYAQKFQG |
| 199 | 3174 | 1206 | GGGATCATCCCTATCTTTGGTACAGTAAACTACGCACAGAAGTTCCAGG GC |
| 199 | 3175 | 1207 | ARDRSVTPRYYGMDV |
| 199 | 3176 | 1208 | GCGAGAGATCGTTCGGTGACCCCTCGCTACTACGGTATGGACGTC |
| 199 | 3177 | 1209 | GAAATTGTGATGACACAGTCTCCAGCCACCCTGTCTTTGTCTCCAGGGGA AAGAGCCACCCTCTCCTGCAGGGCCAGTCAGAGTGTTAGCAGCTACTTA GCCTGGTACCAACAGAAACCTGGCCAGGCTCCCAGGCTCCTCATCTATG ATGCATCCAACAGGGCCACTGGCATCCCAGCCAGGTTCAGTGGCAGTGG GTCTGGGACAGACTTCACTCTCACCATCAGCAGCCTAGAGCCTGAAGAT TTTGCAGTTTATTACTGTCAGCACCGTAGCAACTGGCCTCCACTCACTTT CGGCCCTGGGACCAAGCTGGAGATCAAA |
| 199 | 3178 | 1210 | EIVMTQSPATLSLSPGERATLSCRASQSVSSYLAWYQQKPGQAPRLLIYDAS NRATGIPARFSGSGSGTDFTLTISSLEPEDFAVYYCQHRSNWPPLTFGPGTKL EIK |
| 199 | 3179 | 1211 | RASQSVSSYLA |
| 199 | 3180 | 1212 | AGGGCCAGTCAGAGTGTTAGCAGCTACTTAGCC |
| 199 | 3181 | 1213 | DASNRAT |
| 199 | 3182 | 1214 | GATGCATCCAACAGGGCCACT |
| 199 | 3183 | 1215 | QHRSNWPPLT |
| 199 | 3184 | 1216 | CAGCACCGTAGCAACTGGCCTCCACTCACT |
| 200 | 3185 | 1217 | GAGGTGCAGCTGTTGGAGTCTGGGGGAGGCCTGGTCAAGCCTGGGGGGT CCCTGAGACTCTCCTGTGCAGCCTCGGGATTCACCATCAGTGGTTATAAC ATGTTCTGGGTCCGCCAGCCTCCGGGGAAGGGGCTGGAGTGGGTCTCAT CCATTACTGCTGGTAGTAGTTATTTAAACTATGCAGACTCAGTGAAGGGC CGTTTCATCGTCTCCAGAGACAACGCCAAGAATTCACTGTATCTGCAAAT GAACAGCTGAGAGCCGAGGACACGGCTGTTTATTTCTGTGCGAGAGCA CCTCTTTTACCCGCTATGATGGACCTCTGGGGCCAAGGGACCACGGTCAC CGTCTCCTCA |

TABLE 6-continued

Informal Sequence Listing

| Antibody No. | Seq. Ref. No. | SEQ ID NO. | Sequence |
|---|---|---|---|
| 200 | 3186 | 1218 | EVQLLESGGGLVKPGGSLRLSCAASGFTISGYNMFWVRQPPGKGLEWVSSI TAGSSYLNYADSVKGRFIVSRDNAKNSLYLQMNSLRAEDTAVYFCARAPLL PAMMDLWGQGTTVTVSS |
| 200 | 3187 | 1219 | FTISGYNMF |
| 200 | 3188 | 1220 | TTCACCATCAGTGGTTATAACATGTTC |
| 200 | 3189 | 1221 | SITAGSSYLNYADSVKG |
| 200 | 3190 | 1222 | TCCATTACTGCTGGTAGTAGTTATTTAAACTATGCAGACTCAGTGAAGGG C |
| 200 | 3191 | 1223 | ARAPLLPAMMDL |
| 200 | 3192 | 1224 | GCGAGAGCACCTCTTTTACCCGCTATGATGGACCTC |
| 200 | 3193 | 1225 | CAGTCTGTGCTGACGCAGCCGCCCTCAGTGTCTGGGGCCCCAGGGCAGA GGGTCACCATCTCCTGCACTGGGAGCAGCTCCAACATCGGGGCAGGTTA TGATGTACACTGGTACCAGCAACTTCCAGGAACAGCCCCCAAACTCCTC ATCTATACTAACAACAATCGGCCCTCAGGGGTCCCTGACCGATTCTCTGG CTCCAAGTCTGGCACCTCAGCCTCCCTGGCCATCACTGGGCTCCAGGCTG AGGATGAGGCTGACTATTACTGCCAGTCCTATGACAGAAGCCTGAATGG TTATGTCTTCGGAACTGGGACCAAGGTCACCGTCCTA |
| 200 | 3194 | 1226 | QSVLTQPPSVSGAPGQRVTISCTGSSSNIGAGYDVHWYQQLPGTAPKLLIYT NNNRPSGVPDRFSGSKSGTSASLAITGLQAEDEADYYCQSYDRSLNGYVFG TGTKVTVL |
| 200 | 3195 | 1227 | TGSSSNIGAGYDVH |
| 200 | 3196 | 1228 | ACTGGGAGCAGCTCCAACATCGGGGCAGGTTATGATGTACAC |
| 200 | 3197 | 1229 | TNNNRPS |
| 200 | 3198 | 1230 | ACTAACAACAATCGGCCCTCA |
| 200 | 3199 | 1231 | QSYDRSLNGYV |
| 200 | 3200 | 1232 | CAGTCCTATGACAGAAGCCTGAATGGTTATGTC |
| 201 | 3201 | 1233 | GAGGTGCAGCTGGTGGAGTCTGGGGCTGAGGTGAAGAAGCCTGGGTCCT CGGTGAAGGTCTCCTGCAAGGCTTCTGCAGACACCTTCAGCAGTTATGCT ATCAGCTGGGTGCGGCAGGCCCCTGGACAAGGGCTTGAGTGGATGGGAG GGATCCTCCCTATCCTTGGTACAGCAAACTCCGCACAGAAGTTCCGGGG CAGAGTCACGTTTACCGCGGACGAATCCACGACCACAGCCTACATGGAA CTGAGCAGCCTGAGATCTGAGGACACGGCCGTCTATTACTGCGCGAGGC TTGCTGGACCACGGTGGCCGGGGTACGGTATGGACGTCTGGGGCCAAGG GACCCTGGTCACCGTCTCCTCA |
| 201 | 3202 | 1234 | EVQLVESGAEVKKPGSSVKVSCKASADTFSSYAISWVRQAPGQGLEWMGGI LPILGTANSAQKFRGRVTFTADESTTTAYMELSSLRSEDTAVYYCARLAGPR WPGYGMDVWGQGTLVTVSS |
| 201 | 3203 | 1235 | DTFSSYAIS |
| 201 | 3204 | 1236 | GACACCTTCAGCAGTTATGCTATCAGC |
| 201 | 3205 | 1237 | GILPILGTANSAQKFRG |
| 201 | 3206 | 1238 | GGGATCCTCCCTATCCTTGGTACAGCAAACTCCGCACAGAAGTTCCGGG GC |
| 201 | 3207 | 1239 | ARLAGPRWPGYGMDV |
| 201 | 3208 | 1240 | GCGAGGCTTGCTGGACCACGGTGGCCGGGGTACGGTATGGACGTC |
| 201 | 3209 | 1241 | GACATCCAGTTGACCCAGTCTCCATCCTTCCTGTCTGCTTCTGTAGGAGA CAGAGTCACCATCACTTGCCGGGCCAGTCAGGGCATTAGCAGTTATTTA GCCTGGTATCAACAGAAACCAGGGAAAGCCCCTAAACTCCTGATCTATG |

TABLE 6-continued

Informal Sequence Listing

| Antibody No. | Seq. Ref. No. | SEQ ID NO. | Sequence |
|---|---|---|---|
| | | | CTGCATCCACTTTGCAAAGTGGGGTCCCATCAAGGTTCAGCGGCAGTGG<br>ATCTGGGACAGAATTCACTCTCACAATCAGCAGCCTGCAGCCTGAAGAT<br>TTTGCAACTTATTACTGTCAGCAGCTTAACAGTTTCCCCCTCACCTTCGG<br>CGGAGGGACCAAGGTGGAAATCAAA |
| 201 | 3210 | 1242 | DIQLTQSPSFLSASVGDRVTITCRASQGISSYLAWYQQKPGKAPKLLIYAAST<br>LQSGVPSRFSGSGSGTEFTLTISSLQPEDFATYYCQQLNSFPLTFGGGTKVEIK |
| 201 | 3211 | 1243 | RASQGISSYLA |
| 201 | 3212 | 1244 | CGGGCCAGTCAGGGCATTAGCAGTTATTTAGCC |
| 201 | 3213 | 1245 | AASTLQS |
| 201 | 3214 | 1246 | GCTGCATCCACTTTGCAAAGT |
| 201 | 3215 | 1247 | QQLNSFPLT |
| 201 | 3216 | 1248 | CAGCAGCTTAACAGTTTCCCCCTCACC |
| 202 | 3217 | 1249 | CAGGTCCAGCTGGTGCAGTCTGGGGCTGAGGTGACGAAGCCTGGGGCCT<br>CAGTGAGGGTCTCCTGCAAATTTTCCGCATACACCCTCTCTGCATTATCC<br>ATTCACTGGGTGCGACAGGCTCCTGGAAAAGGCCTTGAGTGGATGGGAG<br>CTTTTGATCCTGAGGATGGTGAGCCAATCTACTCACAGCATTTCCAGGGC<br>AGAGTCACCATGACCGAGGACACTTCTACACAGACAGCCTACATGGAGC<br>TGAACAGCCTGAGATCTGAGGACACGGCCGTTTATTACTGTTCATCCGTA<br>GGACCAGCGGGGTGGTTCGACCCCTGGGGCCAGGGAACCCTGGTCACCG<br>TCTCCTCA |
| 202 | 3218 | 1250 | QVQLVQSGAEVTKPGASVRVSCKFSAYTLSALSIHWVRQAPGKGLEWMGA<br>FDPEDGEPIYSQHFQGRVTMTEDTSTQTAYMELNSLRSEDTAVYYCSSVGP<br>AGWFDPWGQGTLVTVSS |
| 202 | 3219 | 1251 | YTLSALSIH |
| 202 | 3220 | 1252 | TACACCCTCTCTGCATTATCCATTCAC |
| 202 | 3221 | 1253 | AFDPEDGEPIYSQHFQG |
| 202 | 3222 | 1254 | GCTTTTGATCCTGAGGATGGTGAGCCAATCTACTCACAGCATTTCCAGGG<br>C |
| 202 | 3223 | 1255 | SSVGPAGWFDP |
| 202 | 3224 | 1256 | TCATCCGTAGGACCAGCGGGGTGGTTCGACCCC |
| 202 | 3225 | 1257 | GACATCCGGTTGACCCAGTCTCCATCCTCCCTGTCTGCATCTGTGGGAGA<br>CAGAGTCAGCATCACTTGCCGGGCAAGTCAGAGCATTAGCAGCTATTTA<br>CATTGGTATCAACAAAAACCAGGGAAAGCCCCTAAGCTCCTGATCTATG<br>CTGCATCCAGTTTGCAAAGTGGGGTCCCATCAAGGTTCAGTGGCAGTGG<br>ATCTGGGTCAGATTTCACTCTCACCATCAGCAGTCTGCAACCTGAAGATT<br>TTGCAACTTACTACTGTCACCAGAGTTACATTCCCCCATTCACTTTCGGC<br>CCTGGGACCAAGCTGGAGATCAAA |
| 202 | 3226 | 1258 | DIRLTQSPSSLSASVGDRVSITCRASQSISSYLHWYQQKPGKAPKLLIYAASS<br>LQSGVPSRFSGSGSGSDFTLTISSLQPEDFATYYCHQSYIPPFTFGPGTKLEIK |
| 202 | 3227 | 1259 | RASQSISSYLH |
| 202 | 3228 | 1260 | CGGGCAAGTCAGAGCATTAGCAGCTATTTACAT |
| 202 | 3229 | 1261 | AASSLQS |
| 202 | 3230 | 1262 | GCTGCATCCAGTTTGCAAAGT |
| 202 | 3231 | 1263 | HQSYIPPFT |
| 202 | 3232 | 1264 | CACCAGAGTTACATTCCCCCATTCACT |
| 203 | 3233 | 1265 | GAGGTGCAGCTGGTGGAGTCTGGGGGAGGCCTGGTCAAGCCTGGGGGGT<br>CCCTGAGACTCTCCTGTGCAGCCTCTGGATTCACCATCACTAGCTATGGC<br>ATGAACTGGGTCCGCCAGGCTCCAGGAAAGGGGCTGGAGTGGGTCTCAT<br>CCATTAGTAGTAGTAGTAGTTTCATACACTATGGAGACTCAGTGAAGGG<br>TCGATTCACCATCTCCAGAGACAACGCCAAGAACTCACTGTATCTGCAA |

TABLE 6-continued

Informal Sequence Listing

| Antibody No. | Seq. Ref. No. | SEQ ID NO. | Sequence |
|---|---|---|---|
| | | | ATGAACAGCCTGAGAGCCGGGGACACGGCTGTATACTACTGTGTGAGAG<br>ACTCGGGCCACCAGGACTACCGCGGGGACTACTGGGGCCAGGGAACCCT<br>GGTCACCGTCTCCTCA |
| 203 | 3234 | 1266 | EVQLVESGGGLVKPGGSLRLSCAASGFTITSYGMNWVRQAPGKGLEWVSSI<br>SSSSSFIHYGDSVKGRFTISRDNAKNSLYLQMNSLRAGDTAVYYCVRDSGH<br>QDYRGDYWGQGTLVTVSS |
| 203 | 3235 | 1267 | FTITSYGMN |
| 203 | 3236 | 1268 | TTCACCATCACTAGCTATGGCATGAAC |
| 203 | 3237 | 1269 | SISSSSSFIHYGDSVKG |
| 203 | 3238 | 1270 | TCCATTAGTAGTAGTAGTAGTTTTCATACACTATGGAGACTCAGTGAAGG<br>GT |
| 203 | 3239 | 1271 | VRDSGHQDYRGDY |
| 203 | 3240 | 1272 | GTGAGAGACTCGGGCCACCAGGACTACCGCGGGGACTAC |
| 203 | 3241 | 1273 | CAGTCTGTGGTGACGCAGCCGCCCTCAGTGTCTGGGGCCCCAGGGCAGA<br>GGGTCTCCATCTCCTGCACTGGGAGCAGCTCCAACATCGGGGCAGGTTA<br>TGATGTACACTGGTACCAGCAGCTTCCAGGAACAGCCCCCAAACTCCTC<br>ATCTATACTAACAACAATCGGCCCTCAGGGGTCCCTGACCGATTCTCTGG<br>CTCCAAGTCTGGCACCTCAGCCTCCCTGGCCATCAATGGGCTCCAGGCTG<br>AGGATGAGGCTGATTATTACTGCCAGTCCTATGACAGGAGCCTGAGTGG<br>TTGGGTGTTCGGCGGAGGGACCAAGCTCACCGTCCTA |
| 203 | 3242 | 1274 | QSVVTQPPSVSGAPGQRVSISCTGSSSNIGAGYDVHWYQQLPGTAPKLLIYT<br>NNNRPSGVPDRFSGSKSGTSASLAINGLQAEDEADYYCQSYDRSLSGWVFG<br>GGTKLTVL |
| 203 | 3243 | 1275 | TGSSSNIGAGYDVH |
| 203 | 3244 | 1276 | ACTGGGAGCAGCTCCAACATCGGGGCAGGTTATGATGTACAC |
| 203 | 3245 | 1277 | TNNNRPS |
| 203 | 3246 | 1278 | ACTAACAACAATCGGCCCTCA |
| 203 | 3247 | 1279 | QSYDRSLSGWV |
| 203 | 3248 | 1280 | CAGTCCTATGACAGGAGCCTGAGTGGTTGGGTG |
| 204 | 3249 | 1281 | CAGGTGCAGCTGGTGGAGTCTGGTCCTGCGTTGGTGAAACCCACACAGA<br>CCCTCACACTGACCTGCGCCTTCTCTGGGTTCTCACTCACCACTCGTGGG<br>ATGTCTGTGAGCTGGATCCGTCAGCCCCCAGGGAAGGCCCTGGAGTGGC<br>TTGCACGCATTGATTGGGATGATGATAAATACTACAGCACCTCTCTGAA<br>GACCAGGCTCACCATCTCCAAGGACACCTCCAAAAACCAGGTGGTCCTC<br>ACAATGAGCAACATGGACCCTGTGGACACAGCCACGTATTACTGTGCAC<br>GGGCGTCTCTCTATGATAGTGGTGGCTATTACCTTTTTTTCTTTGACTACT<br>GGGGCCAGGGAACCCTGGTCACCGTCTCCTCA |
| 204 | 3250 | 1282 | QVQLVESGPALVKPTQTLTLTCAFSGFSLTTRGMSVSWIRQPPGKALEWLA<br>RIDWDDDKYYSTSLKTRLTISKDTSKNQVVLTMSNMDPVDTATYYCARAS<br>LYDSGGYYLFFFDYWGQGTLVTVSS |
| 204 | 3251 | 1283 | FSLTTRGMSVS |
| 204 | 3252 | 1284 | TTCTCACTCACCACTCGTGGGATGTCTGTGAGC |
| 204 | 3253 | 1285 | RIDWDDDKYYSTSLKT |
| 204 | 3254 | 1286 | CGCATTGATTGGGATGATGATAAATACTACAGCACCTCTCTGAAGACC |
| 204 | 3255 | 1287 | ARASLYDSGGYYLFFFDY |
| 204 | 3256 | 1288 | GCACGGGCGTCTCTCTATGATAGTGGTGGCTATTACCTTTTTTTCTTTGAC<br>TAC |
| 204 | 3257 | 1289 | GATATTGTGATGACTCAGTCTCCATCCTCCCTGTCTGCATCTGTTGGAGA<br>CAGAGTCACCATCACTTGCCGGGCAAGTCAGAGCATTGGCAGTTATTTA<br>AATTGGTATCAGCAGAAACCAGGGAAAGTCCCGAAACTCCTGATCTATG |

TABLE 6-continued

Informal Sequence Listing

| Antibody No. | Seq. Ref. No. | SEQ ID NO. | Sequence |
|---|---|---|---|
| | | | CTGCATCCAATTTGCAAGGTGGGGTCCCATCAAGGTTTCGTGGCAGTGG<br>ATCTGGGACAGATTTCACTCTCACCATCAGCAATCTGCAACCTGAAGATT<br>TTGCAAGTTACTACTGTCAACTGAGTTACAGTAGCCTTTGGACGTTCGGC<br>CAAGGGACCAAGGTGGAAATCAAA |
| 204 | 3258 | 1290 | DIVMTQSPSSLSASVGDRVTITCRASQSIGSYLNWYQQKPGKVPKLLIYAAS<br>NLQGGVPSRFRGSGSGTDFTLTISNLQPEDFASYYCQLSYSSLWTFGQGTKV<br>EIK |
| 204 | 3259 | 1291 | RASQSIGSYLN |
| 204 | 3260 | 1292 | CGGGCAAGCCAGAGCATTGGCAGTTATTTAAAT |
| 204 | 3261 | 1293 | AASNLQG |
| 204 | 3262 | 1294 | GCTGCATCCAATTTGCAAGGT |
| 204 | 3263 | 1295 | QLSYSSLWT |
| 204 | 3264 | 1296 | CAACTGAGTTACAGTAGCCTTTGGACG |
| 205 | 3265 | 1297 | CAGGTGCAGCTGGTGGAGTCTGGGGGAGGCGTGGTCCAGCCTGGGAGGT<br>CCCTGAGAGTCTCCTGTGCAGCCTCTGGATTTGACTTCAGTAACTATGCC<br>ATGCACTGGGTCCGCCAGGCTCCAGGCAAGGGGCTGGAGTGGGTGGCAC<br>TTATATCCTATGATGGAAATAATAAAGTCTATGCAGACTCCGTGAAGGG<br>CCGATTCACCGTCTCCAGAGACAATTCCAAAAACACACTTTATCTGCAA<br>ATGAACAGCCTGAGACCTGAAGACACGGCTGTGATTTACTGTGCGAAAG<br>ATGGCTATCTGGCTCCTGACTTCTGGGGCCAGGGAACCCTGGTCACCGTC<br>TCCTCA |
| 205 | 3266 | 1298 | QVQLVESGGGVVQPGRSLRVSCAASGFDFSNYAMHWVRQAPGKGLEWVA<br>LISYDGNNKVYADSVKGRFTVSRDNSKNTLYLQMNSLRPEDTAVIYCAKDG<br>YLAPDFWGQGTLVTVSS |
| 205 | 3267 | 1299 | FDFSNYAMH |
| 205 | 3268 | 1300 | TTTGACTTCAGTAACTATGCCATGCAC |
| 205 | 3269 | 1301 | LISYDGNNKVYADSVKG |
| 205 | 3270 | 1302 | CTTATATCCTATGATGGAAATAATAAAGTCTATGCAGACTCCGTGAAGG<br>GC |
| 205 | 3271 | 1303 | AKDGYLAPDF |
| 205 | 3272 | 1304 | GCGAAAGATGGCTATCTGGCTCCTGACTTC |
| 205 | 3273 | 1305 | CAGTCAGTCCTGACTCAGCCTGCCTCCGTGTCTGGGTCTCCTGGACAGTC<br>GATCATCATCTCCTGCACTGGAACCAGCAGTGACGTTGGTGAATATGAC<br>TATGTCTCCTGGTACCAACACCACCCACACAAAGCCCCCAAACTCATAA<br>TTTATGAGGTCAGTAATCGGCCCTCAGGGGTTTCTAATCGCTTCTCTGGC<br>TCCAAGTCTGGCAACACGGCCTCCCTGACCATCTCTGGGCTCCAGGCTGA<br>GGACGAGGCTGATTATTACTGCAGTTCCTACACAAGCAGTAGCGGTCAA<br>GCCTTCGGAACTGGGACCAAGGTCACCGTCCTA |
| 205 | 3274 | 1306 | QSVLTQPASVSGSPGQSIIISCTGTSSDVGEYDYVSWYQHHPHKAPKLIIYEV<br>SNRPSGVSNRFSGSKSGNTASLTISGLQAEDEADYYCSSYTSSSGQAFGTGT<br>KVTVL |
| 205 | 3275 | 1307 | TGTSSDVGEYDYVS |
| 205 | 3276 | 1308 | ACTGGAACCAGCAGTGACGTTGGTGAATATGACTATGTCTCC |
| 205 | 3277 | 1309 | EVSNRPS |
| 205 | 3278 | 1310 | GAGGTCAGTAATCGGCCCTCA |
| 205 | 3279 | 1311 | SSYTSSSGQA |
| 205 | 3280 | 1312 | AGTTCCTACACAAGCAGTAGCGGTCAAGCC |
| 206 | 3281 | 1313 | GAGGTGCAGCTGGTGGAGTCTGGAGGAGGCTTGATCCAGCCTGGGGGGT<br>CCCTGAGACTCTCCTGTGCAGCCTCTGGTTCACCGTCAGTAGCAAGTAC<br>ATGAGCTGGGTCCGCCAGGCTCCAGGGAAGGGGCTGGAGTGGGTCTCAA |

TABLE 6-continued

Informal Sequence Listing

| Antibody No. | Seq. Ref. No. | SEQ ID NO. | Sequence |
|---|---|---|---|
| | | | TTATTTATAGTGGTGGTAGCACATACCACGCAGACTCCGTGAAGGGCCG<br>ATTCACCATCTCCAGAGACAACTCCAAGAACACACTGTATCTTCAAATG<br>AACAGCCTGAGAGCCGAGGACACGGCCGTGTATTACTGTGCGAGAGATG<br>ATTACGATTTTTGGAGTGGCAACGGCCCACCGGAGATGGCCGTCTGGGG<br>CCAGGGGACCACGGTCACCGTCTCCTCA |
| 206 | 3282 | 1314 | EVQLVESGGGLIQPGGSLRLSCAASGFTVSSKYMSWVRQAPGKGLEWVSII<br>YSGGSTYHADSVKGRFTISRDNSKNTLYLQMNSLRAEDTAVYYCARDDYD<br>FWSGNGPPEMAVWGQGTTVTVSS |
| 206 | 3283 | 1315 | FTVSSKYMS |
| 206 | 3284 | 1316 | TTCACCGTCAGTAGCAAGTACATGAGC |
| 206 | 3285 | 1317 | IIYSGGSTYHADSVKG |
| 206 | 3286 | 1318 | ATTATTTATAGTGGTGGTAGCACATACCACGCAGACTCCGTGAAGGGC |
| 206 | 3287 | 1319 | ARDDYDFWSGNGPPEMAV |
| 206 | 3288 | 1320 | GCGAGAGATGATTACGATTTTTGGAGTGGCAACGGCCCACCGGAGATGG<br>CCGTC |
| 206 | 3289 | 1321 | GACATCCGGATGACCCAGTCTCCATCCTCCCTGTCTGCATCTGTAGGAGA<br>CAGAGTCACCATCACTTGCCGGGCGAGTCAGGGCATTAGCAATTATTTA<br>GCCTGGTATCAGCAGAAACCAGGGAAAGTTCCTAAGCTCCTGATCTATG<br>CTGCATCCACTTTGCAATCAGGGGTCCCATCTCGGTTCAGTGGCAGTGGA<br>TCTGAGACAGATTTCACTCTCACCATCAGCAGCCTGCAGCCTGAAGATGT<br>TGCAACTTATTACTGTCAAAAGTATAACAGTGTCCCTCTGACGTTCGGCC<br>AAGGGACCAAGGTGGAAATCAAA |
| 206 | 3290 | 1322 | DIRMTQSPSSLSASVGDRVTITCRASQGISNYLAWYQQKPGKVPKLLIYAAS<br>TLQSGVPSRFSGSGSETDFTLTISSLQPEDVATYYCQKYNSVPLTFGQGTKVE<br>IK |
| 206 | 3291 | 1323 | RASQGISNYLA |
| 206 | 3292 | 1324 | CGGGCGAGTCAGGGCATTAGCAATTATTTAGCC |
| 206 | 3293 | 1325 | AASTLQS |
| 206 | 3294 | 1326 | GCTGCATCCACTTTGCAATCA |
| 206 | 3295 | 1327 | QKYNSVPLT |
| 206 | 3296 | 1328 | CAAAAGTATAACAGTGTCCCTCTGACG |
| 207 | 3297 | 1329 | CAGGTCCAGCTGGTGCAGTCTGGAGCAGAGGTGAAAAAGCCCGGGGAG<br>TCTCTGAAGATCTCCTGTAAGACTTCTGGATACAGATTTACCAATTACTG<br>GATCGGCTGGGTGCGCCAGATGCCCGGGAAAGGCCTGGAGTGGATGGG<br>GATCATCTATCCTGGTGACTCTGATGCCAGATACAGCCCGTCCTTCCAAG<br>GCCAGGTCACCTTCTCAGCCGACAAGTCCATCAGCACCGCCTACCTGCA<br>CTGGAGCAGCCTGAAGGCCTCGGACACCGCCATGTATTACTGTGCGAGA<br>CAAGATGACAGTGGCTGGGCCGACTTCTTTCCCTTTGACTACTGGGGCCA<br>GGGAACCCTGGTCACCGTCTCCTCA |
| 207 | 3298 | 1330 | QVQLVQSGAEVKKPGESLKISCKTSGYRFTNYWIGWVRQMPGKGLEWMGI<br>IYPGDSDARYSPSFQGQVTFSADKSISTAYLHWSSLKASDTAMYYCARQDD<br>SGWADFFPFDYWGQGTLVTVSS |
| 207 | 3299 | 1331 | YRFTNYWIG |
| 207 | 3300 | 1332 | TACAGATTTACCAATTACTGGATCGGC |
| 207 | 3301 | 1333 | ITYPGDSDARYSPSFQG |
| 207 | 3302 | 1334 | ATCATCTATCCTGGTGACTCTGATGCCAGATACAGCCCGTCCTTCCAAGG<br>C |
| 207 | 3303 | 1335 | ARQDDSGWADFFPFDY |
| 207 | 3304 | 1336 | GCGAGACAAGATGACAGTGGCTGGGCCGACTTCTTTCCCTTTGACTAC |

TABLE 6-continued

Informal Sequence Listing

| Antibody No. | Seq. Ref. No. | SEQ ID NO. | Sequence |
|---|---|---|---|
| 207 | 3305 | 1337 | GAAATTGTGTTGACGCAGTCTCCAGGCACCCTGTCTTTGTCTCCAGGGGA<br>AAGAGCCACCCTCTCCTGCAGGGCCAGTCACAGTTTTAGCAGCACCTAC<br>TTAGCCTGGTACCAGCAGAAACCTGGCCAGGCTCCCAGGCTCCTCATCT<br>ATGCTGCATCCAACAGGGCCACTGGCATCCCAGACAGGTTCAGTGGCAG<br>TGGGTCTGGGACAGACTTCACTCTCACCATCAGCAGACTGGAGCCTGAA<br>GATTTTGCAGTGTATTTCTGTCAGCAGTATGATAGCTCACCGTGGACGTT<br>CGGCCAAGGGACCAAGCTGGAGATCAAA |
| 207 | 3306 | 1338 | EIVLTQSPGTLSLSPGERATLSCRASHSFSSTYLAWYQQKPGQAPRLLIYAAS<br>NRATGIPDRFSGSGSGTDFTLTISRLEPEDFAVYFCQQYDSSPWTFGQGTKLE<br>IK |
| 207 | 3307 | 1339 | RASHSFSSTYLA |
| 207 | 3308 | 1340 | AGGGCCAGTCACAGTTTTAGCAGCACCTACTTAGCC |
| 207 | 3309 | 1341 | AASNRAT |
| 207 | 3310 | 1342 | GCTGCATCCAACAGGGCCACT |
| 207 | 3311 | 1343 | QQYDSSPWT |
| 207 | 3312 | 1344 | CAGCAGTATGATAGCTCACCGTGGACG |
| 208 | 3313 | 1345 | CAGGTCCAGCTGGTACAGTCTGGGGCTGAGGTGAAGAAGCCTGGGTCCT<br>CGGTGAAGGTCTCCTGCAGGACTTCTGGAGGCACCTTCAGCAGCTTTTCT<br>ATCAGCTGGGTGCGACAGGCCCCTGGACAAGGACTTGAATGGATGGGAG<br>GGATCATCCCTATCTTTGGGACAGCAAACTACGCAAAGAAATTCCAGGG<br>CAGAGTCACAATTACCGCGGACGAATCCACGGACACAGCCTATATGGAA<br>CTGAGGAGCCTGAGATCTGAGGACACGGCCGTCTATTACTGTGCGAGAG<br>ATTCCCCCAAAATATCAGCAACTGAATATTACTTTGACTACTGGGGCCAG<br>GGAACCCTGGTCACCGTCTCCTCA |
| 208 | 3314 | 1346 | QVQLVQSGAEVKKPGSSVKVSCRTSGGTFSSFSISWVRQAPGQGLEWMGGI<br>IPIFGTANYAKKFQGRVTITADESTDTAYMELRSLRSEDTAVYYCARDSPKIS<br>ATEYYFDYWGQGTLVTVSS |
| 208 | 3315 | 1347 | GTFSSFSIS |
| 208 | 3316 | 1348 | GGCACCTTCAGCAGCTTTTCTATCAGC |
| 208 | 3317 | 1349 | GIIPIFGTANYAKKFQG |
| 208 | 3318 | 1350 | GGGATCATCCCTATCTTTGGGACAGCAAACTACGCAAAGAAATTCCAGG<br>GC |
| 208 | 3319 | 1351 | ARDSPKISATEYYFDY |
| 208 | 3320 | 1352 | GCGAGAGATTCCCCCAAAATATCAGCAACTGAATATTACTTTGACTAC |
| 208 | 3321 | 1353 | GACATCCAGGTGACCCAGTCTCCTTCCACCCTGTCTGCATCTGTAGGAGA<br>CAGAGTCACCATCACTTGCCGGGCCAGTCAGAGTTTTACTAGTTGGTTGG<br>CCTGGTATCAGCAGAAACCAGGGAAAGCCCCTAAGCTCCTGATCTATAA<br>GGCGTCTACTTTAGACAGTGGGGTCCCATCAAGGTTCAGCGGCAGTGGA<br>TCTGGGACAGAATTCACTCTCACCATCAACGGCCTGCAGCCTGATGATTT<br>TGCAACTTACTACTGCCAACACTATGATAGTTATTCGGGGACCTTCGGCC<br>AAGGGACACGACTGGAGATTAAA |
| 208 | 3322 | 1354 | DIQVTQSPSTLSASVGDRVTITCRASQSFTSWLAWYQQKPGKAPKLLIYKAS<br>TLDSGVPSRFSGSGSGTEFTLTINGLQPDDFATYYCQHYDSYSGTFGQGTRL<br>EIK |
| 208 | 3323 | 1355 | RASQSFTSWLA |
| 208 | 3324 | 1356 | CGGGCCAGTCAGAGTTTTACTAGTTGGTTGGCC |
| 208 | 3325 | 1357 | KASTLDS |
| 208 | 3326 | 1358 | AAGGCGTCTACTTTAGACAGT |
| 208 | 3327 | 1359 | QHYDSYSGT |
| 208 | 3328 | 1360 | CAACACTATGATAGTTATTCGGGGACC |

TABLE 6-continued

Informal Sequence Listing

| Antibody No. | Seq. Ref. No. | SEQ ID NO. | Sequence |
|---|---|---|---|
| 209 | 3329 | 1361 | GAGGTGCAGCTGTTGGAGTCTGGGGGAGGCTTGGTACAGCCTGGGGGGT CCCTGAGACTCTCCTGTGCAGCCTCTGGATTCACCTTTAGCAGCTACGCC ATGAGCTGGGTCCGCCAGATTCCAGGGAAGGGGCTGGAGTGGGTCTCAA CAATCAATATTAGTGGTGGTAGTACATACTACGCAGACTCCGTGAAGGG CCGGTTCACCATCTCCAGAGACAATTCCAGGGACACGGTGTTTCTACAA ATGAATGGCCTGAGAGCCGAGGACACGGCCCTATATTACTGCGCGAGGG GATATCATATAGACTGGTTTGACTTTTGGGGCCAGGGAACCCTGGTCACC GTCTCCTCA |
| 209 | 3330 | 1362 | EVQLLESGGGLVQPGGSLRLSCAASGFTFSSYAMSWVRQIPGKGLEWVSTI NISGGSTYYADSVKGRFTISRDNSRDTVFLQMNGLRAEDTALYYCARGYHI DWFDFWGQGTLVTVSS |
| 209 | 3331 | 1363 | FTFSSYAMS |
| 209 | 3332 | 1364 | TTCACCTTTAGCAGCTACGCCATGAGC |
| 209 | 3333 | 1365 | TINISGGSTYYADSVKG |
| 209 | 3334 | 1366 | ACAATCAATATTAGTGGTGGTAGTACATACTACGCAGACTCCGTGAAGG GC |
| 209 | 3335 | 1367 | ARGYHIDWFDF |
| 209 | 3336 | 1368 | GCGAGGGGATATCATATAGACTGGTTTGACTTT |
| 209 | 3337 | 1369 | GATATTGTGCTGACTCAGACTCCATCTTCCGTGTCTGCATCTGTAGGAGA CAGAGTCACCATCACTTGTCGGGCGAGTCAGGATATTGGCAGCTGGTTA GCCTGGTATCAGCAGAAACCAGGGAAAGCCCCTCAATTCCTGATCTATG CTGCATCCCAATTGCAAAGTGGGGTCCCATCAAGGTTCAGCGGCAGTGG ATCTGGGACAGATTTCACTCTTACCATCAGCAGCCTGCAGCCTGAAGATT TTGCAACTTACTATTGTCAACAGGCTAAAAGTTTACCTCGGACTTTCGGC GGAGGGACCAAAGTGGATATCAAA |
| 209 | 3338 | 1370 | DIVLTQTPSSVSASVGDRVTITCRASQDIGSWLAWYQQKPGKAPQFLIYAAS QLQSGVPSRFSGSGSGTDFTLTISSLQPEDFATYYCQQAKSLPRTFGGGTKV DIK |
| 209 | 3339 | 1371 | RASQDIGSWLA |
| 209 | 3340 | 1372 | CGGGCGAGTCAGGATATTGGCAGCTGGTTAGCC |
| 209 | 3341 | 1373 | AASQLQS |
| 209 | 3342 | 1374 | GCTGCATCCCAATTGCAAAGT |
| 209 | 3343 | 1375 | QQAKSLPRT |
| 209 | 3344 | 1376 | CAACAGGCTAAAAGTTTACCTCGGACT |
| 210 | 3345 | 1377 | GAGGTGCAGCTGTTGGAGTCTGGAGGAGGCTTGATCCAGCCTGGGGGGT CCCTGAGACTCTCCTGTGGAGCCTCTGGGTTCACCGTCACTGGCAACTAC ATGCATTGGGTCCGCCAGGCTCCAGGGAAGGGGCTGGAGTGGGTCTCAG TTATTTATGCCGGTTCTAGCACATATTACGCAGACTCCGTGAGGGGCCGA TTCACCATCTCCAGAGACAAGGCCAGGAACACGTTGTTTCTTCAAATGA ATAGACTGAGAGCCGAGGACACGGCCGTGTATTATTGTGCGAGAGCGGG GGTAGTTGGGGAAGATAGAAGTGGCTGGTACGGTCCCGATTATTTCCAC GGTTTGGACGTCTGGGGCCAAGGGACCACGGTCACCGTCTCCTCA |
| 210 | 3346 | 1378 | EVQLLESGGGLIQPGGSLRLSCGASGFTVTGNYMHWVRQAPGKGLEWVSVI YAGSSTYYADSVRGRFTISRDKARNTLFLQMNRLRAEDTAVYYCARAGVV GEDRSGWYGPDYFHGLDVWGQGTTVTVSS |
| 210 | 3347 | 1379 | FTVTGNYMH |
| 210 | 3348 | 1380 | TTCACCGTCACTGGCAACTACATGCAT |
| 210 | 3349 | 1381 | VIYAGSSTYYADSVRG |
| 210 | 3350 | 1382 | GTTATTTATGCCGGTTCTAGCACATATTACGCAGACTCCGTGAGGGGC |
| 210 | 3351 | 1383 | ARAGVVGEDRSGWYGPDYFHGLDV |

TABLE 6-continued

Informal Sequence Listing

| Antibody No. | Seq. Ref. No. | SEQ ID NO. | Sequence |
|---|---|---|---|
| 210 | 3352 | 1384 | GCGAGAGCGGGGGTAGTTGGGGAAGATAGAAGTGGCTGGTACGGTCCC<br>GATTATTTCCACGGTTTGGACGTC |
| 210 | 3353 | 1385 | GAAACGACACTCACGCAGTCTCCAGGCACCCTGTCTTTGTCTCCAGGGG<br>AAAGAGCCACCCTCTCCTGCAGGGCCAGTCAGAGTATTCGCAACAACTA<br>CTTAGCCTGGTACCAGCAAAAACCTGGCCAGCCTCCCAGGCTCCTCATCT<br>ATGGTGAATCCAGAAGGGCCACTGGCATCCCAGGCAGGTTCAGTGGCAG<br>TGGGTCTGGGACAGACTTCACTCTCACCATCAGCAGCCTGGAGCCTGAA<br>GATTTTGCAGTGTATTACTGTCAGCAGTATGGTGGCTCACCGTACACTTTT<br>TGGCCAGGGGACCAAGGTGGATATCAAA |
| 210 | 3354 | 1386 | ETTLTQSPGTLSLSPGERATLSCRASQSIRNNYLAWYQQKPGQPPRLLIYGES<br>RRATGIPGRFSGSGSGTDFTLTISSLEPEDFAVYYCQQYGGSPYTFGQGTKV<br>DIK |
| 210 | 3355 | 1387 | RASQSIRNNYLA |
| 210 | 3356 | 1388 | AGGGCCAGTCAGAGTATTCGCAACAACTACTTAGCC |
| 210 | 3357 | 1389 | GESRRAT |
| 210 | 3358 | 1390 | GGTGAATCCAGAAGGGCCACT |
| 210 | 3359 | 1391 | QQYGGSPYT |
| 210 | 3360 | 1392 | CAGCAGTATGGTGGCTCACCGTACACT |
| 211 | 3361 | 1393 | CAGGTCCAGCTTGTGCAGTCTGGGGCTGAGGTGAAGAAGCCTGGGTCCT<br>CGGTGAGGGTCTCCTGCGAGGCTTCTGGAGGCACCTTCAGCACCTATGCT<br>ATTAGCTGGGTGCGACAGGCCCCTGGACTAGGGCTTGAGTGGATGGGAG<br>GGATCCACCCCATCTCTGGTACAGCAAACTACGCACAGAGCTTCCAGGA<br>CAGACTCACCATTACCGTGGACAAGTCCACGAGCACAGCCTACATGGAC<br>CTGAGCAGCCTGAGATCTGAGGACACGGCCATATATTATTGTGCGAGAG<br>TTGGTCTGGGTCGCACTTGGATTTATGATACAATGGGTTACCTTGACTAC<br>TGGGGCCAGGGAACCCTGGTCACCGTCTCCTCA |
| 211 | 3362 | 1394 | QVQLVQSGAEVKKPGSSVRVSCEASGGTFSTYAISWVRQAPGLGLEWMGGI<br>HPISGTANYAQSFQDRLTITVDKSTSTAYMDLSSLRSEDTAIYYCARVGLGR<br>TWIYDTMGYLDYWGQGTLVTVSS |
| 211 | 3363 | 1395 | GTFSTYAIS |
| 211 | 3364 | 1396 | GGCACCTTCAGCACCTATGCTATTAGC |
| 211 | 3365 | 1397 | GIHPISGTANYAQSFQD |
| 211 | 3366 | 1398 | GGGATCCACCCCATCTCTGGTACAGCAAACTACGCACAGAGCTTCCAGG<br>AC |
| 211 | 3367 | 1399 | ARVGLGRTWIYDTMGYLDY |
| 211 | 3368 | 1400 | GCGAGAGTTGGTCTGGGTCGCACTTGGATTTATGATACAATGGGTTACCT<br>TGACTAC |
| 211 | 3369 | 1401 | GAAATTGTATTGACACAGTCTCCAGCCACCCTGTCTTTGTCTCCAGGGGA<br>GAGAGTCACCCTCTCCTGCAGGGCCAGTCAGAGTGTTAACGACTACTTA<br>GCCTGGTACCAACAAAAACCTGGCCAGGCTCCCAGGCTCCTCATCTATG<br>ATGCATCCAACAGGGCCACTGGCATCCCAGCCAGGTTCAGTGGCAGTGG<br>GTCTGGGACAGACTTCACTCTCACCATCAGCAGCCTAGAGCCTGAAGAT<br>TTTGCAGTTTATTACTGTCAGCACCGTACCAACTGGCCTTCCCTCACTTTC<br>GGCGGAGGGACCAAGGTGGAAATCAAA |
| 211 | 3370 | 1402 | EIVLTQSPATLSLSPGERVTLSCRASQSVNDYLAWYQQKPGQAPRLLIYDAS<br>NRATGIPARFSGSGSGTDFTLTISSLEPEDFAVYYCQHRTNWPSLTFGGGTK<br>VEIK |
| 211 | 3371 | 1403 | RASQSVNDYLA |
| 211 | 3372 | 1404 | AGGGCCAGTCAGAGTGTTAACGACTACTTAGCC |
| 211 | 3373 | 1405 | DASNRAT |
| 211 | 3374 | 1406 | GATGCATCCAACAGGGCCACT |

TABLE 6-continued

Informal Sequence Listing

| Antibody No. | Seq. Ref. No. | SEQ ID NO. | Sequence |
|---|---|---|---|
| 211 | 3375 | 1407 | QHRTNWPSLT |
| 211 | 3376 | 1408 | CAGCACCGTACCAACTGGCCTTCCCTCACT |
| 212 | 3377 | 1409 | GAGGTGCAGCTGGTGGAGTCTGGGGGAGGCCTGGTCAAGCCTGGGGGGT<br>CCCTGAGACTCTCCTGTGCAGCCTCGGGATTCACCATCAGTGGTTATAAC<br>ATGTTCTGGGTCCGCCAGCCTCCGGGGAAGGGGCTGGAGTGGGTCTCAT<br>CCATTACTGCTGGTAGTAGTTATTTAAACTATGCAGACTCAGTGAAGGGC<br>CGTTTCATCGTCTCCAGAGACAACGCCAAGAATTCACTGTATCTGCAAAT<br>GAACAGCCTGAGAGCCGAGGACACGGCTGTTTATTTCTGTGCGAGAGCA<br>CCTCTTTTACCCGCTATGATGGACCTCTGGGGCCAAGGGACCACGGTCAC<br>CGTCTCCTCA |
| 212 | 3378 | 1410 | EVQLVESGGGLVKPGGSLRLSCAASGFTISGYNMFWVRQPPGKGLEWVSSI<br>TAGSSYLNYADSVKGRFIVSRDNAKNSLYLQMNSLRAEDTAVYFCARAPLL<br>PAMMDLWGQGTTVTVSS |
| 212 | 3379 | 1411 | FTISGYNMF |
| 212 | 3380 | 1412 | TTCACCATCAGTGGTTATAACATGTTC |
| 212 | 3381 | 1413 | SITAGSSYLNYADSVKG |
| 212 | 3382 | 1414 | TCCATTACTGCTGGTAGTAGTTATTTAAACTATGCAGACTCAGTGAAGGG<br>C |
| 212 | 3383 | 1415 | ARAPLLPAMMDL |
| 212 | 3384 | 1416 | GCGAGAGCACCTCTTTTACCCGCTATGATGGACCTC |
| 212 | 3385 | 1417 | CAGTCTGTGGTGACGCAGCCGCCCTCAGTGTCTGGGGCCCCAGGGCAGA<br>GGGTCACCATCTCCTGCACTGGGAGCAGCTCCAACATCGGGGCAGGTTA<br>TGATGTACACTGGTACCAGCAACTTCCAGGAACAGCCCCCAAACTCCTC<br>ATCTATACTAACAACAATCGGCCCTCAGGGGTCCCTGACCGATTCTCTGG<br>CTCCAAGTCTGGCACCTCAGCCTCCCTGGCCATCACTGGGCTCCAGGCTG<br>AGGATGAGGCTGACTATTACTGCCAGTCCTATGACAGAAGCCTGAATGG<br>TTATGTCTTCGGAACTGGGACCACGGTCACCGTCCTA |
| 212 | 3386 | 1418 | QSVVTQPPSVSGAPGQRVTISCTGSSSNIGAGYDVHWYQQLPGTAPKLLIYT<br>NNNRPSGVPDRFSGSKSGTSASLAITGLQAEDEADYYCQSYDRSLNGYVFG<br>TGTTVTVL |
| 212 | 3387 | 1419 | TGSSSNIGAGYDVH |
| 212 | 3388 | 1420 | ACTGGGAGCAGCTCCAACATCGGGGCAGGTTATGATGTACAC |
| 212 | 3389 | 1421 | TNNNRPS |
| 212 | 3390 | 1422 | ACTAACAACAATCGGCCCTCA |
| 212 | 3391 | 1423 | QSYDRSLNGYV |
| 212 | 3392 | 1424 | CAGTCCTATGACAGAAGCCTGAATGGTTATGTC |
| 213 | 3393 | 1425 | GAGGTGCAGCTGGTGGAGTCTGGGGGAGGCCTGGTCAAGCCTGGGGGGT<br>CCCTGAGACTCTCCTGTGCAGCCCCTGGATTCACCATCAGGAGTTATACC<br>ATGTACTGGGTCCGCCAGGCTCCAGGGAAGGGGCTGGAGTGGGTCGCAT<br>CCATTAGTAGTAGTAGTAGTTACATACACTATGGAGACTCAGTGAAGGG<br>CCGATTCACCATCGCCAGAGACAATGCCAAGAACTCACTGTATCTGCAA<br>ATGAACAGCCTGAGAGCCGAGGACACGGCTGTGTATTACTGTGTGAGAG<br>ATCATTGTACTGGTGGAAGCTGCTACTTAAACGGTATGGACGTCTGGGG<br>CCAAGGGACCACGGTCACCGTCTCCTCA |
| 213 | 3394 | 1426 | EVQLVESGGGLVKPGGSLRLSCAAPGFTIRSYTMYWVRQAPGKGLEWVASI<br>SSSSSYIHYGDSVKGRFTIARDNAKNSLYLQMNSLRAEDTAVYYCVRDHCT<br>GGSCYLNGMDVWGQGTTVTVSS |
| 213 | 3395 | 1427 | FTIRSYTMY |
| 213 | 3396 | 1428 | TTCACCATCAGGAGTTATACCATGTAC |
| 213 | 3397 | 1429 | SISSSSSYIHYGDSVKG |

TABLE 6-continued

Informal Sequence Listing

| Antibody No. | Seq. Ref. No. | SEQ ID NO. | Sequence |
|---|---|---|---|
| 213 | 3398 | 1430 | TCCATTAGTAGTAGTAGTAGTTACATACACTATGGAGACTCAGTGAAGG GC |
| 213 | 3399 | 1431 | VRDHCTGGSCYLNGMDV |
| 213 | 3400 | 1432 | GTGAGAGATCATTGTACTGGTGGAAGCTGCTACTTAAACGGTATGGACG TC |
| 213 | 3401 | 1433 | CAGCCTGTGCTGACTCAGCCACCCTCAGTGTCTGGGGCCCCAGGGCAGA GGGTCACCATCTCCTGCACTGGGACCAGCTCCAACATCGGGGCAGGTTA TGATGTACACTGGTACCAGCAGCTTCCAGGAACAGCCCCCAAACTCCTC ATCTATGGTAACAACAATCGGCCCTCAGGGGTCCCTGACCGATTCTCTGG CTCCAAGTCTGGCACCTCAGCCTCCCTGGCCATCACTGGGCTCCAGGCTG AGGATGAGGCTGATTATTACTGCCAGTCCTATGACAGCAGCCTGAGCGG TTCGGTATTCGGCGGAGGGACCAAGCTCACCGTCCTA |
| 213 | 3402 | 1434 | QPVLTQPPSVSGAPGQRVTISCTGTSSNIGAGYDVHWYQQLPGTAPKWYG NNNRPSGVPDRFSGSKSGTSASLAITGLQAEDEADYYCQSYDSSLSGSVFGG GTKLTVL |
| 213 | 3403 | 1435 | TGTSSNIGAGYDVH |
| 213 | 3404 | 1436 | ACTGGGACCAGCTCCAACATCGGGGCAGGTTATGATGTACAC |
| 213 | 3405 | 1437 | GNNNRPS |
| 213 | 3406 | 1438 | GGTAACAACAATCGGCCCTCA |
| 213 | 3407 | 1439 | QSYDSSLSGSV |
| 213 | 3408 | 1440 | CAGTCCTATGACAGCAGCCTGAGCGGTTCGGTA |
| 214 | 3409 | 1441 | GAGGTGCAGCTGGTGGAGTCTGGAGGAGGCTTGATCCAGCCTGGGGGGT CCCTGAGACTCTCCTGTGCAGCCTCTGGGTTCACCGTCAGTAGCAAGTAC ATGAGCTGGGTCCGCCAGGCTCCAGGGAAGGGGCTGGAGTGGGTCTCAA TTATTTATAGTGGTGGTAGCACATACTACGCAGACTCCGTGAAGGGCCG ATTCACCATCTCCAGAGACAATTCCAAGAACACACTGTATCTTCAAATG AACAGCCTGAGAGCCGAGGACACGGCCGTGTATTACTGTGCGAGAGATG ATTACGATTTTTGGAGTGGCAACGGCCCACCGGAGATGGCCGTCTGGGG CCAGGGGACCACGGTCACCGTCTCCTCA |
| 214 | 3410 | 1442 | EVQLVESGGGLIQPGGSLRLSCAASGFTVSSKYMSWVRQAPGKGLEWVSII YSGGSTYYADSVKGRFTISRDNSKNTLYLQMNSLRAEDTAVYYCARDDYD FWSGNGPPEMAVWGQGTTVTSS |
| 214 | 3411 | 1443 | FTVSSKYMS |
| 214 | 3412 | 1444 | TTCACCGTCAGTAGCAAGTACATGAGC |
| 214 | 3413 | 1445 | IIYSGGSTYYADSVKG |
| 214 | 3414 | 1446 | ATTATTTATAGTGGTGGTAGCACATACTACGCAGACTCCGTGAAGGGC |
| 214 | 3415 | 1447 | ARDDYDFWSGNGPPEMAV |
| 214 | 3416 | 1448 | GCGAGAGATGATTACGATTTTTGGAGTGGCAACGGCCCACCGGAGATGG CCGTC |
| 214 | 3417 | 1449 | GACATGAGACTCACCCAGTCTCCATCCTCCCTGTCTGCGTCTGTAGGAGA CAGAGTCACCATCACTTGCCGGGCGAGTCAGGGCATTAGCAATTATTTA GCCTGGTATCAGCAGAGACCAGGGAAAGTTCCTCAGCTCCTGATCTATA CTGCATCCACTTTGCAATCAGGGGTCCCATCTCGGTTCAGTGGCAGTGGA TCTGAGACAGATTTCACTCTCACCATCAGCAGCCTGCAGCCTGAAGATGT TGCAACTTATTACTGTCAAAAGTATGACAGTGTCCCTCTGACGTTCGGCC AAGGGACCAAGGTGGAAATCAAA |
| 214 | 3418 | 1450 | DMRLTQSPSSLSASVGDRVTITCRASQGISNYLAWYQQRPGKVPQLLIYTAS TLQSGVPSRFSGSGSETDFTLTISSLQPEDVATYYCQKYDSVPLTFGQGTKVE IK |
| 214 | 3419 | 1451 | RASQGISNYLA |
| 214 | 3420 | 1452 | CGGGCGAGTCAGGGCATTAGCAATTATTTAGCC |

TABLE 6-continued

Informal Sequence Listing

| Antibody No. | Seq. Ref. No. | SEQ ID NO. | Sequence |
|---|---|---|---|
| 214 | 3421 | 1453 | TASTLQS |
| 214 | 3422 | 1454 | ACTGCATCCACTTTGCAATCA |
| 214 | 3423 | 1455 | QKYDSVPLT |
| 214 | 3424 | 1456 | CAAAAGTATGACAGTGTCCCTCTGACG |
| 215 | 3425 | 1457 | GAGGTGCAGCTGGTGGAGTCTGGTCCTGCGCTGGTGAAACCCACACAGACCCTCACACTGACCTGCACCGTCTCGGGGGTGTTGAGAGAATGAGTGTGAGTTGGGTCCGTCAGCCCCCAGGGAAGGCCCTGGAGTGGCTTGCACGCATTGATTGGGATGATGATAAATACTACAACACATTTCTGAAGACCAGGCTCACCATCTCCAAGGGCACCTCCAAAAACGAGGTGGTCCTTACAATGACCAACATGGACCCTGAAGACACAGCAATTTATTACTGTGCACGGACGAATCGCTATGATAAAAGTGGTTATTACCTTTATTACCTTGACTACTGGGGCCAGGGAACCCTGGTCACTGTCTCCTCA |
| 215 | 3426 | 1458 | EVQLVESGPALVKPTQTLTLTCTVSGGVERMSVSWVRQPPGKALEWLARIDWDDDKYYNTFLKTRLTISKGTSKNEVVLTMTNMDPEDTAIYYCARTNRYDKSGYYLYYLDYWGQGTLVTVSS |
| 215 | 3427 | 1459 | GVERMSVS |
| 215 | 3428 | 1460 | GGTGTTGAGAGAATGAGTGTGAGT |
| 215 | 3429 | 1461 | RIDWDDDKYYNTFLKT |
| 215 | 3430 | 1462 | CGCATTGATTGGGATGATGATAAATACTACAACACATTTCTGAAGACC |
| 215 | 3431 | 1463 | ARTNRYDKSGYYLYYLDY |
| 215 | 3432 | 1464 | GCACGGACGAATCGCTATGATAAAAGTGGTTATTACCTTTATTACCTTGACTAC |
| 215 | 3433 | 1465 | GACATCCAGATGACCCAGTCTCCATCCTCCCTGTCTGCATCTGTAGGAGACAAAGTCACCATCACTTGCCGGGCAAGTCAGACCATTGCCAGTTATGTAAATTGGTATCAGCAGCACCCAGGGAAAGCCCCTAAGCTCCTAATCTATCTTGCATCCCGTTTGCAAAGTGGTGCCCCATCAAGGTTCAGTGGCAGTGGATCTGGGACAGATTTCACTCTCACCATCCTCAATCTGCAACCTGAAGATTTTGCAACTTACTACTGTCAACAGAGTTACAGTTCGTTTTTCACTTTCGGCCCTGGGACCAAGGTGGAAATCAAA |
| 215 | 3434 | 1466 | DIQMTQSPSSLSASVGDKVTITCRASQTIASYVNWYQQHPGKAPKLLIYLASRLQSGAPSRFSGSGSGTDFTLTILNLQPEDFATYYCQQSYSSFFTFGPGTKVEIK |
| 215 | 3435 | 1467 | RASQTIASYVN |
| 215 | 3436 | 1468 | CGGGCAAGTCAGACCATTGCCAGTTATGTAAAT |
| 215 | 3437 | 1469 | LASRLQS |
| 215 | 3438 | 1470 | CTTGCATCCCGTTTGCAAAGT |
| 215 | 3439 | 1471 | QQSYSSFFT |
| 215 | 3440 | 1472 | CAACAGAGTTACAGTTCGTTTTTCACT |
| 216 | 3441 | 1473 | GAGGTGCAGCTGTTGGAGTCTGGGGGAGGCGTGGTCCAGCCTGGGAGGTCCCTGAGACTCTCCTGTGCAGCCTCTGGATTCACCTTCAGTGACTTTTCTATGCACTGGGTCCGCCAGGCTCCAGGCAAGGGGCTGGAGTGGGTGGCACTCATCTCAAATGATGGAAGCAATAAATATTATTCAGACTCCCTGAAGGGTTCATTCATCATCTCCAGAGACAACTCCAAGAACACGCTCTATCTCCAACTGAACAGCCTGGGAGCTGAGGACACGGCTCTCTATTACTGTGCGAGAGATGCGGTTCCCCATTATGATTACGTCTGGGGAAACTTTGACTACTGGGGCCAGGGAACCCTGGTCACTGTCTCCTCA |
| 216 | 3442 | 1474 | EVQLLESGGVVQPGRSLRLSCAASGFTFSDFSMHWVRQAPGKGLEWVALISNDGSNKYYSDSLKGSFIISRDNSKNTLYLQLNSLGAEDTALYYCARDAVPHYDYVWGNFDYWGQGTLVTVSS |
| 216 | 3443 | 1475 | FTFSDFSMH |

TABLE 6-continued

Informal Sequence Listing

| Antibody No. | Seq. Ref. No. | SEQ ID NO. | Sequence |
|---|---|---|---|
| 216 | 3444 | 1476 | TTCACCTTCAGTGACTTTTCTATGCAC |
| 216 | 3445 | 1477 | LISNDGSNKYYSDSLKG |
| 216 | 3446 | 1478 | CTCATCTCAAATGATGGAAGCAATAAATATTATTCAGACTCCCTGAAGGGT |
| 216 | 3447 | 1479 | ARDAVPHYDYVWGNFDY |
| 216 | 3448 | 1480 | GCGAGAGATGCGGTTCCCCATTATGATTACGTCTGGGGAAACTTTGACTAC |
| 216 | 3449 | 1481 | CAGTCTGTTCTGACTCAGCCTGCCTCCGTGTCTGCGTCTCCTGGACAGTCGATCACCATCTCCTGCACTGGAACCAGCAGTGACGTTGGTGGTTATAATTATGTCTCCTGGTACCAACAGCACCCAGGCAAAGCCCCCAAACTCATAATTTATGAGGTCAGTAATCGGCCCTCAGGGGTTTCTAATCGCTTCTCTGGCTCCAAGTCTGGCAACACGGCCTCCCTGACCATCTCTGGGCTCCAGGCTGACGACGAGGCTGATTATTACTGCAGCTCATATACAAGTTTCACTCCCGTGGTATTCGGCGGAGGGACCAAGCTGACCGTCCTA |
| 216 | 3450 | 1482 | QSVLTQPASVSASPGQSITISCTGTSSDVGGYNYVSWYQQHPGKAPKLIIYEVSNRPSGVSNRFSGSKSGNTASLTISGLQADDEADYYCSSYTSFTPVVFGGGTKLTVL |
| 216 | 3451 | 1483 | TGTSSDVGGYNYVS |
| 216 | 3452 | 1484 | ACTGGAACCAGCAGTGACGTTGGTGGTTATAATTATGTCTCC |
| 216 | 3453 | 1485 | EVSNRPS |
| 216 | 3454 | 1486 | GAGGTCAGTAATCGGCCCTCA |
| 216 | 3455 | 1487 | SSYTSFTPVV |
| 216 | 3456 | 1488 | AGCTCATATACAAGTTTCACTCCCGTGGTA |
| 217 | 3457 | 1489 | CAGGTCCAGCTTGTACAGTCTGGGGCGGAGGTGAAGAAGCCTGGGTCCTCGGTGAAGGTCTCTTGTAAGTCTTCTGGAGGGACCTTCAGCAACTATATTATCAGCTGGGTGCGACAGGCCCCTGGACAAGGGCTTGAGTGGATGGGAGGGATCGTCCCTCTCTCTGGAACAACAGACTACGCACAGAAGTTCCAGGGCCGAGTCACGATTACCGCGGACAAATCCACGACTACAGCCTACATGGAGCTTCGCACCTTGAGACCTGAGGACACGGCCGTCTATTATTGTGCGAGGGGGAGTGGTGGTAGCAATGCCTACTTCGACCCCTGGGGCCAGGGAACCCTGGTCACCGTCTCCTCA |
| 217 | 3458 | 1490 | QVQLVQSGAEVKKPGSSVKVSCKSSGGTFSNYIISWVRQAPGQGLEWMGGIVPLSGTTDYAQKFQGRVTITADKSTTTAYMELRTLRPEDTAVYYCARGSGGSNAYFDPWGQGTLVTVSS |
| 217 | 3459 | 1491 | GTFSNYIIS |
| 217 | 3460 | 1492 | GGGACCTTCAGCAACTATATTATCAGC |
| 217 | 3461 | 1493 | GIVPLSGTTDYAQKFQG |
| 217 | 3462 | 1494 | GGGATCGTCCCTCTCTCTGGAACAACAGACTACGCACAGAAGTTCCAGGC |
| 217 | 3463 | 1495 | ARGSGGSNAYFDP |
| 217 | 3464 | 1496 | GCGAGGGGGAGTGGTGGTAGCAATGCCTACTTCGACCCC |
| 217 | 3465 | 1497 | CAGTCTGTGGTGACGCAGCCGCCCTCAGTGTCAGTGGCCCAGGAAAGACGGCCAAGATTACCTGTGGGGGAAACAACATTGGAAGTAAGAGTGTGTACTGGTACCAACAGAAGCCAGGCCAGGCCCCTGTGCTGGTCATGTATTATGATACTTACCGGCCCTCAGGGATCCCTGAGCGCTTCTCTGGCTCCAACTCTGGGAACTCGGCCACCCTGACCATCAGCAGAGTCGACGCCGGGGATGAGGCCGACTATTACTGTCAGGTGTGGGATAGTAGGAGTGATCATCCTTATGTCTTCGGAAGTGGGACCAAGCTCACCGTCCTA |
| 217 | 3466 | 1498 | QSVVTQPPSVSVAPGKTAKITCGGNNIGSKSVYWYQQKPGQAPVLVMYYDTYRPSGIPERFSGSNSGNSATLISRVDAGDEADYYCQVWDSRSDHPYVFGSGTKLTVL |

TABLE 6-continued

Informal Sequence Listing

| Antibody No. | Seq. Ref. No. | SEQ ID NO. | Sequence |
|---|---|---|---|
| 217 | 3467 | 1499 | GGNNIGSKSVY |
| 217 | 3468 | 1500 | GGGGGAAACAACATTGGAAGTAAGAGTGTGTAC |
| 217 | 3469 | 1501 | YDTYRPS |
| 217 | 3470 | 1502 | TATGATACTTACCGGCCCTCA |
| 217 | 3471 | 1503 | QVWDSRSDHPYV |
| 217 | 3472 | 1504 | CAGGTGTGGGATAGTAGGAGTGATCATCCTTATGTC |
| 218 | 3473 | 1505 | CAGGTCCAGCTGGTGCAGTCTGGGGCTGAGGTGAAGAGGCCTGGGTCGT CGGTGAAGGTCTCCTGCAAGGCTTCTGGAGGCACGTCCAGCAGTTATAT TATCAGTTGGGTGCGACAGGCCCCTGGGCAAGGGCTTGAGTGGATGGGA GGGATCATCCCCATCCCTATTTCTGGCGCACCAACCTACGCACAGAAGTT CCAGGGCAGAGCAAACTATGCACAGAAGTTCGAGGGCAGACTCACGATT ACCGCGGACAGACTCACGAGCACAGCCTACATGGAGCTGAGCAGCCTGA CATCTGAGGACACGGCCGTGTATTATTGTGTAAGAGATGAGAGGAACGG GGGCTATTGGGGCCAGGGAACCCTGGTCACCGTCTCCTCA |
| 218 | 3474 | 1506 | QVQLVQSGAEVKRPGSSVKVSCKASGGTSSSYIISWVRQAPGQGLEWMGGI IPIPISGAPTYAQKFQGRANYAQKFEGRLTITADRLTSTAYMELSSLTSEDTA VYYCVRDERNGGYWGQGTLVTVSS |
| 218 | 3475 | 1507 | GTSSSYIIS |
| 218 | 3476 | 1508 | GGCACGTCCAGCAGTTATATTATCAGT |
| 218 | 3477 | 1509 | GIIPIPISGAPTYAQKFQGRANYAQKFEG |
| 218 | 3478 | 1510 | GGGATCATCCCCATCCCTATTTCTGGCGCACCAACCTACGCACAGAAGTT CCAGGGCAGAGCAAACTATGCACAGAAGTTCGAGGGC |
| 218 | 3479 | 1511 | VRDERNGGY |
| 218 | 3480 | 1512 | GTAAGAGATGAGAGGAACGGGGGCTAT |
| 218 | 3481 | 1513 | CAGTCTGCCCTGACTCAGCCTGCCTCCGTGTCTGGGTCTCCTGGACAGTC GATCACCATCTCCTGCACTGGAACCAGCAATGACGTTGGTGCTTATAATC ATGTGTCGTGGTACCAACAACACCCAGGGAAAGCCCCCAAACTCATGAT CTATGATGTCACTAATCGGCCCTCAGGGGTTTCTAATCGCTTCTCTGGCT CCAAGTCTGGCAACACGGCCTCCCTGACCATCTTTGGGCTCCAGACTGAC GACGAGGCTGATTATTATTGCAGCTCATATACAATCAGCAGCACCTTGGT GTTCGGCGGAGGGACCCAGCTGACCGTCCTC |
| 218 | 3482 | 1514 | QSALTQPASVSGSPGQSITISCTGTSNDVGAYNHVSWYQQHPGKAPKLMIY DVTNRPSGVSNRFSGSKSGNTASLTIFGLQTDDEADYYCSSYTISSTLVFGGG TQLTVL |
| 218 | 3483 | 1515 | TGTSNDVGAYNHVS |
| 218 | 3484 | 1516 | ACTGGAACCAGCAATGACGTTGGTGCTTATAATCATGTGTCG |
| 218 | 3485 | 1517 | DVTNRPS |
| 218 | 3486 | 1518 | GATGTCACTAATCGGCCCTCA |
| 218 | 3487 | 1519 | SSYTISSTLV |
| 218 | 3488 | 1520 | AGCTCATATACAATCAGCAGCACCTTGGTG |
| 219 | 3489 | 1521 | GAGGTGCAGCTGGTGGAGTCTGGGGGAGGCGTGGTCCAGCCTGGGAGGT CCCTGAGGCTCTCCTGTGCAGCCTCTGGATTCACCTTCAGTTCCTATGCA ATGCACTGGGTCCGCCAGGCTCCAGGCAAGGGCCTGGAGTGGGTGGCAG TTATATCATATGATGAAGGCAATGAATACTACGCAGACTCCGTGAAGGG CCGATTCACCATCTCCAGAGCCAATTCCAAGAACACGATTTATCTGCAA ATGAACAGCCTGAGAGCTGAGGACACGGCTGTCTATTACTGTGCGAGAG ATTACATACATGGGGACTACGGTTTGGACGTCTGGGGCCTAGGGACCAC GGTCACCGTCTCCTCA |
| 219 | 3490 | 1522 | EVQLVESGGGVVQPGRSLRLSCAASGFTFSSYAMHWVRQAPGKGLEWVAV ISYDEGNEYYADSVKGRFTISRANSKNTIYLQMNSLRAEDTAVYYCARDYI HGDYGLDVWGLGTTVTVSS |

TABLE 6-continued

Informal Sequence Listing

| Antibody No. | Seq. Ref. No. | SEQ ID NO. | Sequence |
|---|---|---|---|
| 219 | 3491 | 1523 | FTFSSYAMH |
| 219 | 3492 | 1524 | TTCACCTTCAGTTCCTATGCAATGCAC |
| 219 | 3493 | 1525 | VISYDEGNEYYADSVKG |
| 219 | 3494 | 1526 | GTTATATCATATGATGAAGGCAATGAATACTACGCAGACTCCGTGAAGGGC |
| 219 | 3495 | 1527 | ARDYIHGDYGLDV |
| 219 | 3496 | 1528 | GCGAGAGATTACATACATGGGGACTACGGTTTGGACGTC |
| 219 | 3497 | 1529 | GAAATTGTGTTGACACAGTCTCCACTCTCCCTGCCCGTCACCCCTGGAGAGCCGGCCTCCATCTCCTGCAGGTCTAGTCAGAGCCTCCTGCATAGTAATGGATACAACTATTTGGATTGGTACCTGCAGAAGCCAGGGCAGTCTCCACAGCTCCTGATCTATTTGGGTTCTAATCGGGCCTCCGGGGTCCCTGACAGGTTCAGTGGCAGTGGATCAGGCACAGATTTTACACTGAAAATCAGCAGAGTGGAGGCTGAGGATGTTGGGGTTTACTACTGCATGCAACCTCTACAAACAATCACCTTCGGCCAAGGGACACGACTGGAGATTAAA |
| 219 | 3498 | 1530 | EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQPLQTITFGQGTRLEIK |
| 219 | 3499 | 1531 | RSSQSLLHSNGYNYLD |
| 219 | 3500 | 1532 | AGGTCTAGTCAGAGCCTCCTGCATAGTAATGGATACAACTATTTGGAT |
| 219 | 3501 | 1533 | LGSNRAS |
| 219 | 3502 | 1534 | TTGGGTTCTAATCGGGCCTCC |
| 219 | 3503 | 1535 | MQPLQTIT |
| 219 | 3504 | 1536 | ATGCAACCTCTACAAACAATCACC |
| 220 | 3505 | 1537 | CAGGTCCAGCTGGTGCAGTCTGGGGCTGAGGTGAAGAAGCCTGGGGCCTCAGTGAAGGTCTCCTGCAAGGCTTCTGGATACACCTTCACCGACTACTATATGCACTGGGTGCGACAGGCCCCTGGACAAGGGCTTGAGTGGGTGGGATGGATCAACCCTAACAGTGGTTCCACAAACTATGCACAGAAGTTTCAGGGCAGGGTCACCGTGACCAGGGACACGTCCATCAGCACAGCCTACATGGACCTGAGCAGACTGAGATCTGACGACACGGCCGTGTATTACTGTGCGAGCAGGAGCTGGGACCATGATGCTTTTGATATCTGGGGCCAAGGGACAATGGTCACTGTCTCCTCA |
| 220 | 3506 | 1538 | QVQLVQSGAEVKKPGASVKVSCKASGYTFTDYYMHWVRQAPGQGLEWVGWINPNSGSTNYAQKFQGRVTVTRDTSISTAYMDLSRLRSDDTAVYYCASRSWDHDAFDIWGQGTMVTSS |
| 220 | 3507 | 1539 | YTFTDYYMH |
| 220 | 3508 | 1540 | TACACCTTCACCGACTACTATATGCAC |
| 220 | 3509 | 1541 | WINPNSGSTNYAQKFQG |
| 220 | 3510 | 1542 | TGGATCAACCCTAACAGTGGTTCCACAAACTATGCACAGAAGTTTCAGGC |
| 220 | 3511 | 1543 | ASRSWDHDAFDI |
| 220 | 3512 | 1544 | GCGAGCAGGAGCTGGGACCATGATGCTTTTGATATC |
| 220 | 3513 | 1545 | CAGTCTGTCTTGACGCAGCCGCCCTCAGTGTCTGGGGCCCCAGGGCAGAGGGTCACCATCTCCTGCACTGGGAGTAGCTCCAACATCGGGGCAGGTTATGATGTACACTGGTACCAGCAGCTTCCAGGAAGAGCCCCCAAACTCCTCATCTTTGGTAACAGCAATCGGCCCTCAGGGGTCCCTGACCGATTCTCTGGCTCCAAGTCTGGCACCTCAGCCTCCCTGGCCATCACTGGGCTCCAGCCTGAGGATGAGGCTGATTATTACTGCACTGCTATGACAGCAGGCTGAGTGTGGTCTTCGGCGGAGGGACCAAGCTCACCGTCCTA |

TABLE 6-continued

Informal Sequence Listing

| Antibody No. | Seq. Ref. No. | SEQ ID NO. | Sequence |
|---|---|---|---|
| 220 | 3514 | 1546 | QSVLTQPPSVSGAPGQRVTISCTGSSSNIGAGYDVHWYQQLPGRAPKLLIFG NSNRPSGVPDRFSGSKSGTSASLAITGLQPEDEADYYCHCYDSRLSVVFGGG TKLTVL |
| 220 | 3515 | 1547 | TGSSSNIGAGYDVH |
| 220 | 3516 | 1548 | ACTGGGAGTAGCTCCAACATCGGGGCAGGTTATGATGTACAC |
| 220 | 3517 | 1549 | GNSNRPS |
| 220 | 3518 | 1550 | GGTAACAGCAATCGGCCCTCA |
| 220 | 3519 | 1551 | HCYDSRLSVV |
| 220 | 3520 | 1552 | CACTGCTATGACAGCAGGCTGAGTGTGGTC |
| 221 | 3521 | 1553 | CAGGTCCAGCTGGTACAGTCTGGGACTGAGGTGAAGAAGCCTGGGTCTT CGGTGAAGGTCTCCTGCAAGGCTTCGGGAGGCACCTTCAGTAGCTATGC TATCAGCTGGGTGCGACAGGCCCCTGGACAAGGGCTTGAGTGGATGGGA GGGATCCACCCTACCTCTGGTCCAGCAAATTACGCACAGAAGTTCCAGG ATAGAGTCACCATTACCGTGGACAAGTCCACGAGCACAGTCTACATGGA CCTGAGCAGCCTGAGATCTGAGGACACGGCCGTGTATTACTGTGCGAGA GTTGGTGTGGGTCGCACTTGGATATATGATACAATGGGTTACCTTGACTT CTGGGGCCAGGGAACCCTGGTCACCGTCTCTTCA |
| 221 | 3522 | 1554 | QVQLVQSGTEVKKPGSSVKVSCKASGGTFSSYAISWVRQAPGQGLEWMGG IHPTSGPANYAQKFQDRVTITVDKSTSTVYMDLSSLRSEDTAVYYCARVGV GRTWIYDTMGYLDFWGQGTLVTVSS |
| 221 | 3523 | 1555 | GTFSSYAIS |
| 221 | 3524 | 1556 | GGCACCTTCAGTAGCTATGCTATCAGC |
| 221 | 3525 | 1557 | GIHPTSGPANYAQKFQD |
| 221 | 3526 | 1558 | GGGATCCACCCTACCTCTGGTCCAGCAAATTACGCACAGAAGTTCCAGG AT |
| 221 | 3527 | 1559 | ARVGVGRTWIYDTMGYLDF |
| 221 | 3528 | 1560 | GCGAGAGTTGGTGTGGGTCGCACTTGGATATATGATACAATGGGTTACC TTGACTTC |
| 221 | 3529 | 1561 | GAAATTGTGATGACACAGTCTCCAGCCACGCTGTCTTTGTCTCCAGGAGA AAGAGCCACCCTCTCCTGCAGGGCCAGTCAGAGTGTTAGCGACTACTTA GCCTGGTACCAACAAAAACCTGGCCAGGCTCCCAGGCTCCTCATCTATG ATGCATCCAACAGGGCCACTGGCATCCCAGCCAGGTTCAGTGGCAGTGG GTCTGGGACAGACTTCACTCTCACCATCACCAGCCTAGAGCCTGAAGAT TTTGCAGTTTATTACTGTCAGCACCGTAGCGACTGGCCTTCCCTCACTTTC GGCGGAGGGACCAAGCTGGAGATCAAA |
| 221 | 3530 | 1562 | EIVMTQSPATLSLSPGERATLSCRASQSVSDYLAWYQQKPGQAPRLLIYDAS NRATGIPARFSGSGSGTDFTLTITSLEPEDFAVYYCQHRSDWPSLTFGGGTKL EIK |
| 221 | 3531 | 1563 | RASQSVSDYLA |
| 221 | 3532 | 1564 | AGGGCCAGTCAGAGTGTTAGCGACTACTTAGCC |
| 221 | 3533 | 1565 | DASNRAT |
| 221 | 3534 | 1566 | GATGCATCCAACAGGGCCACT |
| 221 | 3535 | 1567 | QHRSDWPSLT |
| 221 | 3536 | 1568 | CAGCACCGTAGCGACTGGCCTTCCCTCACT |
| 222 | 3537 | 1569 | GAGGTGCAGCTGGTGGAGTCTGGGGGAGGCTTGGTACAGCCTGGCAGGT CCCTGAGACTCTCCTGTGTAACTTCGGGATTCGGCTTTGATGACTATGCC ATGCACTGGGTCCGGCAAGCCCCAGGGAAGGGCCTGGAGTGGGTCTCAG GGATTGGTTGGAATAGTGGTGGCATAGGCTATGCGGACTCTGTGAAGGG CCGATTCTCCATCTCCAGAGACAACGCCAAGAACTCCTTGTATCTACAAA TGAACAGTCTGAGACCTGAAGACACTGCCTTCTATTACTGTGTAAAAGA |

TABLE 6-continued

Informal Sequence Listing

| Antibody No. | Seq. Ref. No. | SEQ ID NO. | Sequence |
|---|---|---|---|
| | | | TGGGACCCCTATAGCAGTGGCTGGATACTTTGAATACTGGGGCCAGGGA<br>ACCCTGGTCACCGTCTCCTCA |
| 222 | 3538 | 1570 | EVQLVESGGGLVQPGRSLRLSCVTSGFGFDDYAMHWVRQAPGKGLEWVS<br>GIGWNSGGIGYADSVKGRFSISRDNAKNSLYLQMNSLRPEDTAFYYCVKDG<br>TPIAVAGYFEYWGQGTLVTVSS |
| 222 | 3539 | 1571 | FGFDDYAMH |
| 222 | 3540 | 1572 | TTCGGCTTTGATGACTATGCCATGCAC |
| 222 | 3541 | 1573 | GIGWNSGGIGYADSVKG |
| 222 | 3542 | 1574 | GGGATTGGTTGGAATAGTGGTGGCATAGGCTATGCGGACTCTGTGAAGG<br>GC |
| 222 | 3543 | 1575 | VKDGTPIAVAGYFEY |
| 222 | 3544 | 1576 | GTAAAAGATGGGACCCCTATAGCAGTGGCTGGATACTTTGAATAC |
| 222 | 3545 | 1577 | TCCTATGAGCTGACACAGCCGCCCTCAGCGTCTGGTACCCCCGGGCAGA<br>GGGTCACCATCTCTTGTTCTGGAGGCAGGTCCAACATCGGAAATAATTAT<br>GTATACTGGTACCAGCAGCTCCCAGGAACGGCCCCCAAACTCCTCATCT<br>ATAGGCATGATCAGCGGCCCTCAGGGGTCCCTGACCGATTCTCTGGCTCC<br>AAGTCTGGCACCTCAGCCTCCCTGGCCATCAATGGGCTCCGGTCCGAGG<br>ATGAGGCTGACTATTTTTGCGCAGTATGGGATGACAGCCTGAGTTGTTAT<br>GTCTTCGGAGCTGGGACCAAGCTCACCGTCCTA |
| 222 | 3546 | 1578 | SYELTQPPSASGTPGQRVTISCSGGRSNIGNNYVYWYQQLPGTAPKLLIYRH<br>DQRPSGVPDRFSGSKSGTSASLAINGLRSEDEADYFCAVWDDSLSCYVFGA<br>GTKLTVL |
| 222 | 3547 | 1579 | SGGRSNIGNNYVY |
| 222 | 3548 | 1580 | TCTGGAGGCAGGTCCAACATCGGAAATAATTATGTATAC |
| 222 | 3549 | 1581 | RHDQRPS |
| 222 | 3550 | 1582 | AGGCATGATCAGCGGCCCTCA |
| 222 | 3551 | 1583 | AVWDDSLSCYV |
| 222 | 3552 | 1584 | GCAGTATGGGATGACAGCCTGAGTTGTTATGTC |
| 223 | 3553 | 1585 | CAGGTCCAGCTGGTGCAGTCTGGGGCTGAGGTGAAGAAGCCTGGGTCCT<br>CGGTGAAGGTCTCCTGCAAGGCCTCTGGAGGCACCTTCAGCACCTATGG<br>TATCAGCTGGGTGCGACAGGCCCCTGGACAAGGTCTTGAGTGGATGGGA<br>AGGGTCATCCCTATGTTTGGAACAGCAACCTACGCACAGAAGTTCCAGG<br>ACAGAGTCACGATTACCGCGGACAAAGCCACGAGCACGGCGTACATGG<br>AGCTGAACAGCCTGAGATCTGACGACACGGCCGTATATTACTGTGCGAG<br>ATGTCCTCCTTTTGAGGGAGTTCGTCCGCCCTGGTTCGACCCCTGGGGCC<br>AGGGAACCCTGGTCACCGTCTCTTCA |
| 223 | 3554 | 1586 | QVQLVQSGAEVKKPGSSVKVSCKASGGTFSTYGISWVRQAPGQGLEWMGR<br>VIPMFGTATYAQKFQDRVTITADKATSTAYMELNSLRSDDTAVYYCARCPP<br>FEGVRPPWFDPWGQGTLVTVSS |
| 223 | 3555 | 1587 | GTFSTYGIS |
| 223 | 3556 | 1588 | GGCACCTTCAGCACCTATGGTATCAGC |
| 223 | 3557 | 1589 | RVIPMFGTATYAQKFQD |
| 223 | 3558 | 1590 | AGGGTCATCCCTATGTTTGGAACAGCAACCTACGCACAGAAGTTCCAGG<br>AC |
| 223 | 3559 | 1591 | ARCPPFEGVRPPWFDP |
| 223 | 3560 | 1592 | GCGAGATGTCCTCCTTTTGAGGGAGTTCGTCCGCCCTGGTTCGACCCC |
| 223 | 3561 | 1593 | TCCTATGAGCTGACTCAGCCACCCTCGGTGTCAGTGGCCCAGGACGGA<br>CGGCCAAGATTACCTGTGGGGGATACAACATTGGAAATAAACGTGTGCA<br>CTGGTACCGGCAGAGGCAGGCCAGGCCCCAGTGCTGATCGTCTATGAT<br>AATGCCGACCGGCCCTCAGGGATCCCTGAGCGATTCTCTGGCTCCAACTC |

TABLE 6-continued

Informal Sequence Listing

| Antibody No. | Seq. Ref. No. | SEQ ID NO. | Sequence |
|---|---|---|---|
| | | | TGGGAACACGGCCACCCTGACCATCAGCAACGTCGCAGCCGGGGATGAG<br>GCCGACTATCACTGTCAGGTGTGGGAAACTAGTAGTGATCATCCGGTAT<br>TCGGCGGAGGGACCAAGCTCACCGTCCTA |
| 223 | 3562 | 1594 | SYELTQPPSVSVAPGRTAKITCGGYNIGNKRVHWYRQRPGQAPVLIVYDNA<br>DRPSGIPERFSGSNSGNTATLTISNVAAGDEADYHCQVWETSSDHPVFGGGT<br>KLTVL |
| 223 | 3563 | 1595 | GGYNIGNKRVH |
| 223 | 3564 | 1596 | GGGGGATACAACATTGGAAATAAACGTGTGCAC |
| 223 | 3565 | 1597 | DNADRPS |
| 223 | 3566 | 1598 | GATAATGCCGACCGGCCCTCA |
| 223 | 3567 | 1599 | QVWETSSDHPV |
| 223 | 3568 | 1600 | CAGGTGTGGGAAACTAGTAGTGATCATCCGGTA |
| 224 | 3569 | 1601 | GAGGTGCAGCTGGTGCAGTCTGGAACAGAGGTGAAAAAGCCCGGGGAA<br>TCTCTGAAGATCTCTTGTAAGGCTTCTGGATACAGCTCTTTCCCCAATTG<br>GATCGGCTGGGTGCGCCAGATGCCCGGGAAAGGCCTGGAGTACATGGG<br>GTCCATCTITCCTGATGACTCTAATACCAGATATAGTCCGTCCTTCCGAG<br>GCCTGGTCGCCATCTCAGCCGACAAGTCCCTGAGAACCGCCTATCTGCA<br>GTGGAGCAGCCTGAAGGCCTCGGACAGCGCCATATATTACTGTGCGAGA<br>GGGCCCTTCCCGCACTACTTTGACTCCTGGGGTCAGGGAACCCTGGTCAC<br>CGTCTCCTCA |
| 224 | 3570 | 1602 | EVQLVQSGTEVKKPGESLKISCKASGYSSFPNWIGWVRQMPGKGLEYMGSI<br>FPDDSNTRYSPSFRGLVAISADKSLRTAYLQWSSLKASDSAIYYCARGPFPH<br>YFDSWGQGTLVTVSS |
| 224 | 3571 | 1603 | YSSFPNWIG |
| 224 | 3572 | 1604 | TACAGCTCTTTCCCCAATTGGATCGGC |
| 224 | 3573 | 1605 | SIFPDDSNTRYSPSFRG |
| 224 | 3574 | 1606 | TCCATCTTTCCTGATGACTCTAATACCAGATATAGTCCGTCCTTCCGAGG<br>C |
| 224 | 3575 | 1607 | ARGPFPHYFDS |
| 224 | 3576 | 1608 | GCGAGAGGGCCCTTCCCGCACTACTTTGACTCC |
| 224 | 3577 | 1609 | AATTTTATGCTGACTCAGCCCCACTCTGTGTCGGAGTCTCCGGGGAAGAC<br>GGTCACCATCTCCTGCACCCGCAGCAGTGGCAGTATTGCCCGCAACTAT<br>GTGCAGTGGTACCAGCAGCGCCCGGGCAGTTCCCCCACCACTGTGATCT<br>ATGAGGATGACCAAAGACCCCCTGGGGTCCCTGATCGGTTCTCTGGCTC<br>CATCGACAGCTCCTCCAACTCTGCCTCCCTCACCATCTCTGGACTGCAGA<br>CTGAGGACGAGGCTGACTACTACTGTCAGTCTTATGATCCCACCAATCA<br>AAATGTCTTCGGAACTGGGACCAAGCTCACCGTCCTA |
| 224 | 3578 | 1610 | NFMLTQPHSVSESPGKTVTISCTRSSGSIARNYVQWYQQRPGSSPTTVIYEDD<br>QRPPGVPDRFSGSIDSSSNSASLTISGLQTEDEADYYCQSYDPTNQNVFGTGT<br>KLTVL |
| 224 | 3579 | 1611 | TRSSGSIARNYVQ |
| 224 | 3580 | 1612 | ACCCGCAGCAGTGGCAGTATTGCCCGCAACTATGTGCAG |
| 224 | 3581 | 1613 | EDDQRPP |
| 224 | 3582 | 1614 | GAGGATGACCAAAGACCCCCT |
| 224 | 3583 | 1615 | QSYDPTNQNV |
| 224 | 3584 | 1616 | CAGTCTTATGATCCCACCAATCAAAATGTC |
| 225 | 3585 | 1617 | GAGGTGCAGCTGGTGGAGTCTGGGGAGGCGTGGTCCAGCCTGGGAGGT<br>CCCTGAGACTCTCCTGTGAAGCCTCTGGATTCAACTTCCATAATTATGAT<br>ATACAATGGGTCCGCCAGGCCCCAGGCAAGGGGCTGGAGTGGGTGGCA<br>CTAGTATTATTTGATGGAAGCAAAAAATATTATCCACACTCTGTGAAGG |

TABLE 6-continued

Informal Sequence Listing

| Antibody No. | Seq. Ref. No. | SEQ ID NO. | Sequence |
|---|---|---|---|
| | | | GCCGATTCGCCATCTCCAGAGACAACTCCAAAAAAACTCTATTTCTGCA AATGAACAGCCTGAGACCTGAGGACACGGCTGTGTATTACTGTGCGAGA GCCCCAGTGACTGGCGCCTCGTATTACCTTGACTATTGGGGCCAGGGAA CCCTGGTCACCGTCTCCTCA |
| 225 | 3586 | 1618 | EVQLVESGGGVVQPGRSLRLSCEASGFNFHNYDIQWVRQAPGKGLEWVAL VLFDGSKKYYPHSVKGRFAISRDNSKKTLFLQMNSLRPEDTAVYYCARAPV TGASYYLDYWGQGTLVTVSS |
| 225 | 3587 | 1619 | FNFHNYDIQ |
| 225 | 3588 | 1620 | TTCAACTTCCATAATTATGATATACAA |
| 225 | 3589 | 1621 | LVLFDGSKKYYPHSVKG |
| 225 | 3590 | 1622 | CTAGTATTATTTGATGGAAGCAAAAAATATTATCCACACTCTGTGAAGG GC |
| 225 | 3591 | 1623 | ARAPVTGASYYLDY |
| 225 | 3592 | 1624 | GCGAGAGCCCCAGTGACTGGCGCCTCGTATTACCTTGACTAT |
| 225 | 3593 | 1625 | TCCTATGTGCTGACACAGCCACCCTCGGTGTCAGTGGCCCCAGGACAGA CGGCCAGAATTACCTGTGGGGCAAACAACATTGGAAATAAAGGTGTGCA CTGGTACCAACAGAAGCCAGGCCAGGCCCCTGTGCTGGTCGTCTATGAT GATGACGACCAGCCCTCAGGGATCCCTGAGCGATTCTCTGGCTCCAACT CTGGGAACACGGCCACCCTGACCATCAGCAGGGTCGAAGCCGGGGATG AGGCCGACTATTACTGTCAGGTGTGGGATAGTACTAGTGATCATCTGGT ATTCGGCGGAGGGACCCAGCTGACCGTCCTA |
| 225 | 3594 | 1626 | SYVLTQPPSVSVAPGQTARITCGANNIGNKGVHWYQQKPGQAPVLVVYDD DDQPSGIPERFSGSNSGNTATLTISRVEAGDEADYYCQVWDSTSDHLVFGG GTQLTVL |
| 225 | 3595 | 1627 | GANNIGNKGVH |
| 225 | 3596 | 1628 | GGGGCAAACAACATTGGAAATAAAGGTGTGCAC |
| 225 | 3597 | 1629 | DDDDQPS |
| 225 | 3598 | 1630 | GATGATGACGACCAGCCCTCA |
| 225 | 3599 | 1631 | QVWDSTSDHLV |
| 225 | 3600 | 1632 | CAGGTGTGGGATAGTACTAGTGATCATCTGGTA |
| 226 | 3601 | 1633 | CAGGTGCAGCTGCAGGAGTCGGGCCCAGGACTGGTGAAGCCTTCGGAGA CCCTGTCCCTCACCTGCACTGTCTCTGGTGGCTCCGTCAGCAGAGGGAGT TACTACTGGACCTGGATCCGGCAGCCCCCAGGGAAGGGACTGGAGTGGA TTGGCTATATCTATTACAGTGGGAGCACCAACTACAACCCCTCCCTCAAG AGTCGAGTCACCATATCAGTAGACACGTCCAAGAACCAGTTCTCCCTGA AGCTGAGCTCTGTGACCGCTGCGGACACGGCCGTTTATTACTGTGCGAG AGATATAGGGGAAGATAAGTATGGTACTTACTACGGTATGGACGTCTGG GGCCAAGGGACCACGGTCACCGTCTCTTCA |
| 226 | 3602 | 1634 | QVQLQESGPGLVKPSETLSLTCTVSGGSVSRGSYYWTWIRQPPGKGLEWIG YIYYSGSTNYNPSLKSRVTISVDTSKNQFSLKLSSVTAADTAVYYCARDIGE DKYGTYYGMDVWGQGTTVTVSS |
| 226 | 3603 | 1635 | GSVSRGSYYWT |
| 226 | 3604 | 1636 | GGCTCCGTCAGCAGAGGGAGTTACTACTGGACC |
| 226 | 3605 | 1637 | YIYYSGSTNYNPSLKS |
| 226 | 3606 | 1638 | TATATCTATTACAGTGGGAGCACCAACTACAACCCCTCCCTCAAGAGT |
| 226 | 3607 | 1639 | ARDIGEDKYGTYYGMDV |
| 226 | 3608 | 1640 | GCGAGAGATATAGGGGAAGATAAGTATGGTACTTACTACGGTATGGACG TC |
| 226 | 3609 | 1641 | GAAATTGTGATGACACAGTCTCCAGCCACCCTGTCTTTGTCTCCAGGAGA AAGAGCCACCCTCTCCTGCAGGGCCAGTCAGAGTGTTAGCAGCTCCTTA |

TABLE 6-continued

Informal Sequence Listing

| Antibody No. | Seq. Ref. No. | SEQ ID NO. | Sequence |
|---|---|---|---|
| | | | GCCTGGTACCAACAGAAACCTGGCCAGGCTCCCAGGCTCCTCATCTATG<br>GTGCATCCAACAGGGCCACTGGCATCCCAGCCAGGTTCAGTGGCAGTGG<br>GTCTGGGACAGACTTCACTCTCACCATCAGTAGCCTAGAGCCTGAGGAT<br>TTTGCAGTTTATTACTGTCAGCAGCGTACCAACTGGCCCCCGGTCACTTT<br>CGGCCCTGGGACCAAGGTGGAAATCAAA |
| 226 | 3610 | 1642 | EIVMTQSPATLSLSPGERATLSCRASQSVSSSLAWYQQKPGQAPRLLIYGAS<br>NRATGIPARFSGSGSGTDFTLTISSLEPEDFAVYYCQQRTNWPPVTFGPGTKV<br>EIK |
| 226 | 3611 | 1643 | RASQSVSSSLA |
| 226 | 3612 | 1644 | AGGGCCAGTCAGAGTGTTAGCAGCTCCTTAGCC |
| 226 | 3613 | 1645 | GASNRAT |
| 226 | 3614 | 1646 | GGTGCATCCAACAGGGCCACT |
| 226 | 3615 | 1647 | QQRTNWPPVT |
| 226 | 3616 | 1648 | CAGCAGCGTACCAACTGGCCCCCGGTCACT |
| 227 | 3617 | 1649 | CAGGTCCAGCTGGTACAGTCTGGGGGAGGCCTGGTCAAGCCTGGGGGGT<br>CCCTGAGACTCTCTTGTGCAGCCTCTGGATTCACCTTCAGTAGCTATACC<br>ATGAACTGGGTCCGCCAGGCTCCAGGGAAGGGGCTGGAGTGGGTCTCAT<br>CCATTACTGGTGGTAGTAGTTTCACAAACTACGCAGACTCACTGGAGGG<br>CCGATTCACCATCTCCAGAGATAACGCCAAGAGCTCACTTTTTCTGCAAA<br>TGAACAGCCTGAGAGTCGAGGACACGGCTGTATATTACTGTGCGAGAGA<br>TCAGCCGGGGACGATTTTTGGAGTGGTCCAGGACTACTGGGGCCAGGGA<br>ACCCTGGTCACCGTCTCCTCA |
| 227 | 3618 | 1650 | QVQLVQSGGGLVKPGGSLRLSCAASGFTFSSYTMNWVRQAPGKGLEWVSS<br>ITGGSSFTNYADSLEGRFTISRDNAKSSLFLQMNSLRVEDTAVYYCARDQPG<br>TIFGVVQDYWGQGTLVTVSS |
| 227 | 3619 | 1651 | FTFSSYTMN |
| 227 | 3620 | 1652 | TTCACCTTCAGTAGCTATACCATGAAC |
| 227 | 3621 | 1653 | SITGGSSFTNYADSLEG |
| 227 | 3622 | 1654 | TCCATTACTGGTGGTAGTAGTTTCACAAACTACGCAGACTCACTGGAGG<br>GC |
| 227 | 3623 | 1655 | ARDQPGTIFGVVQDY |
| 227 | 3624 | 1656 | GCGAGAGATCAGCCGGGGACGATTTTTGGAGTGGTCCAGGACTAC |
| 227 | 3625 | 1657 | CAGTCTGTCTTGACGCAGCCGCCCTCAGTGTCTGGGGCCCCAGGGCAGA<br>GGGTCACCATCTCCTGCACTGGGGGCAGCTCCAACATCGGGGCAGGTTA<br>TGATGTGCACTGGTACCAGCAGCTTCCAGGAACAGCCCCCAAACTCCTC<br>ATCTATGGTAACAGCAATCGGCCCTCAGGGGTCCCTGACCGATTCTCTGG<br>CTCCAAGTCTGGCACCTCAGCCTCCCTGGCCATCACTGGGCTCCAGGCTG<br>AGGATGAGGCTGATTATTACTGCCAGTCCTATGACAGCCGCCTGAGTGT<br>GGTATTCGGCGGAGGGACCAAGGTGACCGTCCTA |
| 227 | 3626 | 1658 | QSVLTQPPSVSGAPGQRVTISCTGGSSNIGAGYDVHWYQQLPGTAPKLLIYG<br>NSNRPSGVPDRFSGSKSGTSASLAITGLQAEDEADYYCQSYDSRLSVVFGGG<br>TKVTVL |
| 227 | 3627 | 1659 | TGGSSNIGAGYDVH |
| 227 | 3628 | 1660 | ACTGGGGGCAGCTCCAACATCGGGGCAGGTTATGATGTGCAC |
| 227 | 3629 | 1661 | GNSNRPS |
| 227 | 3630 | 1662 | GGTAACAGCAATCGGCCCTCA |
| 227 | 3631 | 1663 | QSYDSRLSVV |
| 227 | 3632 | 1664 | CAGTCCTATGACAGCCGCCTGAGTGTGGTA |
| 228 | 3633 | 1665 | GAGGTGCAGCTGGTGGAGTCTGGGGCTGAGGTGAAGAAGCCTGGGTCCT<br>CGGTGAAGGTCTCCTGCAAGGCTTCTGGAGGCACCTTCAGCAGCTATGC |

TABLE 6-continued

Informal Sequence Listing

| Antibody No. | Seq. Ref. No. | SEQ ID NO. | Sequence |
|---|---|---|---|
| | | | TATCAGCTGGGTGCGACAGGCCCCTGGACAAGGACTTGAGTGGATGGGA GGGACCATCCCTATTTTTGGTACAATCAACTACGCACAGAAGTTCCAGG GCAGACTCACGATTAACGCGGACGCATCAACGAGCACAGCCTACATGGA GCTGAGCAGCCTGAGATCTGAGGACACGGCCGTGTATTTCTGTGCGAGA GACCGGACTACAGCTGTGAGGTACTACGCTATGGACGTCTGGGGCCAAG GGACCACGGTCACCGTCTCTTCA |
| 228 | 3634 | 1666 | EVQLVESGAEVKKPGSSVKVSCKASGGTFSSYAISWVRQAPGQGLEWMGG TIPIFGTINYAQKFQGRLTINADASTSTAYMELSSLRSEDTAVYFCARDRTTA VRYYAMDVWGQGTTVTVSS |
| 228 | 3635 | 1667 | GTFSSYAIS |
| 228 | 3636 | 1668 | GGCACCTTCAGCAGCTATGCTATCAGC |
| 228 | 3637 | 1669 | GTIPIFGTINYAQKFQG |
| 228 | 3638 | 1670 | GGGACCATCCCTATTTTTGGTACAATCAACTACGCACAGAAGTTCCAGG GC |
| 228 | 3639 | 1671 | ARDRTTAVRYYAMDV |
| 228 | 3640 | 1672 | GCGAGAGACCGGACTACAGCTGTGAGGTACTACGCTATGGACGTC |
| 228 | 3641 | 1673 | GAAATTGTGTTGACACAGTCTCCAGCCACCCTGTCTTTGTCTCCAGGGGA AAGAGCCACCCTCTCCTGCAGGGCCAGTCAGAGTGTTAGCAGCTACTTA GCCTGGTACCAACAGAAACCTGGCCAGGCTCCCAGGCTCCTCATCTATG ATACATCCAACAGGGCCACTGACATCCCAGCCAGGTTCAGTGGCAGTGG GTCTGGGACAGACTTCACTCTCACCATCAGCAGCCTAGAGCCTGAAGAT TTTGCAGTTTATTACTGTCAGCACCGTGCCAACTGGCCCCCGCTCACTTT CGGCGGAGGGACCAAGGTGGAAATCAAA |
| 228 | 3642 | 1674 | EIVLTQSPATLSLSPGERATLSCRASQSVSSYLAWYQQKPGQAPRLLIYDTSN RATDIPARFSGSGSGTDFTLTISSLEPEDFAVYYCQHRANWPPLTFGGGTKV EIK |
| 228 | 3643 | 1675 | RASQSVSSYLA |
| 228 | 3644 | 1676 | AGGGCCAGTCAGAGTGTTAGCAGCTACTTAGCC |
| 228 | 3645 | 1677 | DTSNRAT |
| 228 | 3646 | 1678 | GATACATCCAACAGGGCCACT |
| 228 | 3647 | 1679 | QHRANWPPLT |
| 228 | 3648 | 1680 | CAGCACCGTGCCAACTGGCCCCCGCTCACT |
| 229 | 3649 | 1681 | CAGGTCCAGCTTGTGCAGTCTGGGCCTGAGGTGAAGAGGCCTGGGTCCT CGGTGAAGGTCTCCTGCAAGGCTTCTGGAGACACCTTCAACAACTACGC CATCAGCTGGGTGCGACAGGCCCCTGGACAAGGACTTGAGTGGATGGGA GGGATCCACCCTACCACTGCTACACCAAACTACGCACAGAAGTTCCAGG GCAGAGTCGTCATTAGCGCGGACAAGTCCACGAGTACAGCCTACTTGGA CCTGAGTCGGCTGAGATCTGAGGACACGGCCATGTATTACTGTGCGAGA GTTGGTGTGGGACGCACTTGGGTCTATGATATTATGGGTTACCTAGACTA CTGGGGCCAGGGAACCCTGGTCACCGTCTCCTCA |
| 229 | 3650 | 1682 | QVQLVQSGPEVKRPGSSVKVSCKASGDTFNNYAISWVRQAPGQGLEWMGG IHPTTATPNYAQKFQGRVVISADKSTSTAYLDLSRLRSEDTAMYYCARVGV GRTWVYDIMGYLDYWGQGTLVTVSS |
| 229 | 3651 | 1683 | DTFNNYAIS |
| 229 | 3652 | 1684 | GACACCTTCAACAACTACGCCATCAGC |
| 229 | 3653 | 1685 | GIHPTTATPNYAQKFQG |
| 229 | 3654 | 1686 | GGGATCCACCCTACCACTGCTACACCAAACTACGCACAGAAGTTCCAGG GC |
| 229 | 3655 | 1687 | ARVGVGRTWVYDIMGYLDY |
| 229 | 3656 | 1688 | GCGAGAGTTGGTGTGGGACGCACTTGGGTCTATGATATTATGGGTTACCT AGACTAC |

TABLE 6-continued

Informal Sequence Listing

| Antibody No. | Seq. Ref. No. | SEQ ID NO. | Sequence |
|---|---|---|---|
| 229 | 3657 | 1689 | GAAATTGTATTGACACAGTCTCCAGCCACCCTGTCTTTGTCTCCAGGGGAAAGAGCCACCCTCTCCTGCAGGGCCAGTCAGAGTGTTAGCGACTACTTGGCCTGGTACCAACAAAGACCTGGCCAGGCTCCCAGGCTCCTCATCTATGATGCGTCCACCAGGGCCACTGGCATCCCAGACAGGTTCAGTGGCGGTGGGTCTGGGACAGACTTCACTCTCACCATCAGCAGCCTAGAGCCTGAAGATTTTGCAGTTTATTACTGTCAACACCGTAACAACTGGCCTTCCCTCACTTTCGGCGGAGGGACCAAGGTGGAAATCAAA |
| 229 | 3658 | 1690 | EIVLTQSPATLSLSPGERATLSCRASQSVSDYLAWYQQRPGQAPRLLIYDASTRATGIPDRFSGGGSGTDFTLTISSLEPEDFAVYYCQHRNNWPSLTFGGGTKVEIK |
| 229 | 3659 | 1691 | RASQSVSDYLA |
| 229 | 3660 | 1692 | AGGGCCAGTCAGAGTGTTAGCGACTACTTGGCC |
| 229 | 3661 | 1693 | DASTRAT |
| 229 | 3662 | 1694 | GATGCGTCCACCAGGGCCACT |
| 229 | 3663 | 1695 | QHRNNWPSLT |
| 229 | 3664 | 1696 | CAACACCGTAACAACTGGCCTTCCCTCACT |
| 230 | 3665 | 1697 | CAGGTGCAGCTACAGCAGTGGGGCGCAGGACTGCTGAAGCCTTCGGAGACCCTGTCCCTCACCTGCGGTGTCTCTGATGGGTCCTTCAGTGCCTACTACTGGAACTGGATCCGCCAGTCCCCAGGGAAGGGGCTGGAGTGGATTGGGGAAACCAATCCAAGTGAAAACACCAACTACAGCCCGTCCCTCAAGAATCGAGTCACCATATCGGCAGACAGGTCCGCGAATCAGTTCTCCCTGAGACTGAGGTCTGTGACCGCCGCGGACACGGGTGTTTATTACTGTGCGAGAGGCCGCGGTTATTATGGTTCGACGACTGATTATCGGGGGCTCCACTGGTTCGACCCCTGGGGCCAGGGAACCCTGGTCACCGTCTCCTCA |
| 230 | 3666 | 1698 | QVQLQQWGAGLLKPSETLSLTCGVSDGSFSAYYWNWIRQSPGKGLEWIGETNPSENTNYSPSLKNRVTISADRSANQFSLRLRSVTAADTGVYYCARGRGYYGSTTDYRGLHWFDPWGQGTLVTVSS |
| 230 | 3667 | 1699 | GSFSAYYWN |
| 230 | 3668 | 1700 | GGGTCCTTCAGTGCCTACTACTGGAAC |
| 230 | 3669 | 1701 | ETNPSENTNYSPSLKN |
| 230 | 3670 | 1702 | GAAACCAATCCAAGTGAAAACACCAACTACAGCCCGTCCCTCAAGAAT |
| 230 | 3671 | 1703 | ARGRGYYGSTTDYRGLHWFDP |
| 230 | 3672 | 1704 | GCGAGAGGCCGCGGTTATTATGGTTCGACGACTGATTATCGGGGGCTCCACTGGTTCGACCCC |
| 230 | 3673 | 1705 | GAAACGACACTCACGCAGTCTCCAGTCACCCTGTCTGTGTCTCCAGGGGAAAGAGCCACCCTCTCCTGCAGGGCCAGTCAGAGTGTTAGCTTCAACTTAGCCTGGTACCAGCAGAAACCTGGCCAGGCTCCCAGGCTCCTCATCTATGGTGCATCCACCAGGGTCACTAATCTCCCACTCAGGTTCAGTGGCAGTGGGTCTGGGACAGAGTTCACTCTCACCATCAGCAGCCTGCAGTCTGAAGATTTTGCAGTTTATTACTGTCAGCAGTATAATAACTGGCCTCGGACTTTTGGCCAGGGGACCAAGCTGGAGATCAAA |
| 230 | 3674 | 1706 | ETTLTQSPVTLSVSPGERATLSCRASQSVSFNLAWYQQKPGQAPRLLIYGASTRVTNLPLRFSGSGSGTEFTLTISSLQSEDFAVYYCQQYNNWPRTFGQGTKLEIK |
| 230 | 3675 | 1707 | RASQSVSFNLA |
| 230 | 3676 | 1708 | AGGGCCAGTCAGAGTGTTAGCTTCAACTTAGCC |
| 230 | 3677 | 1709 | GASTRVT |
| 230 | 3678 | 1710 | GGTGCATCCACCAGGGTCACT |
| 230 | 3679 | 1711 | QQYNNWPRT |
| 230 | 3680 | 1712 | CAGCAGTATAATAACTGGCCTCGGACT |

TABLE 6-continued

Informal Sequence Listing

| Antibody No. | Seq. Ref. No. | SEQ ID NO. | Sequence |
|---|---|---|---|
| 231 | 3681 | 1713 | GAGGTGCAGCTGGTGGAGTCTGGGGGAGGCTTGGTTCAGCCGGGGGGT<br>CCCTGAGACTCTCCTGTGCAGCCTCTGGATTCACTTTCAGCGACTTTTCC<br>ATGAGCTGGGTCCGCCAGGCTCCAGGGAAGGGGCTGGAATGGGTCTCAC<br>TTATTAAAAGTAGCGGTTATGCATACTATGCAGACTCCGTGAGGGGCCG<br>GTTCACCATCTCCAGAGACAATTCCAAGAACACCCTGTATCTGCAAATG<br>AACAGCCTGAGAGCCGAGGACACGGCCATATATTATTGTGCGAAAGACG<br>CCGATTTTTGGAGTGGTGCCGCCTACAATGGAGGATACAACTTTGACTCC<br>TGGGGCCAGGGAACCCTGGTCACCGTCTCCTCA |
| 231 | 3682 | 1714 | EVQLVESGGGLVQPGGSLRLSCAASGFTFSDFSMSWVRQAPGKGLEWVSLI<br>KSSGYAYYADSVRGRFTISRDNSKNTLYLQMNSLRAEDTAIYYCAKDADF<br>WSGAAYNGGYNFDSWGQGTLVTVSS |
| 231 | 3683 | 1715 | FTFSDFSMS |
| 231 | 3684 | 1716 | TTCACTTTCAGCGACTTTTCCATGAGC |
| 231 | 3685 | 1717 | LIKSSGYAYYADSVRG |
| 231 | 3686 | 1718 | CTTATTAAAAGTAGCGGTTATGCATACTATGCAGACTCCGTGAGGGGC |
| 231 | 3687 | 1719 | AKDADFWSGAAYNGGYNFDS |
| 231 | 3688 | 1720 | GCGAAAGACGCCGATTTTTGGAGTGGTGCCGCCTACAATGGAGGATACA<br>ACTTTGACTCC |
| 231 | 3689 | 1721 | GACATCCAGATGACCCAGTCTCCAGCCACCCTGTCTGTATTTCCAGGGGA<br>CAGAGCCACCCTCTCCTGCAGGGCCAGTCAGAGTGTTGGCAGCAACTTG<br>GCCTGGTACCAGCAGAAACCTGGCCAGGCTCCCAGGCTCCTCATCTTTG<br>GTGCCTCAACCAGGGCCACTGGTATCCCAGCCAGGTTCAGTGGCAGTGG<br>GTCTGGGACAGAGTTCACTCTCACCATCAGCAGCCTGCAGTCTGAAGAT<br>TTTGCAGTTTATTACTGTCAGCAGTATCATAACTGGCCTCCGCTCACTTTC<br>GGCGGAGGGACCAAAGTGGATATCAAA |
| 231 | 3690 | 1722 | DIQMTQSPATLSVFPGDRATLSCRASQSVGSNLAWYQQKPGQAPRLLIFGAS<br>TRATGIPARFSGSGSGTEFTLTISSLQSEDFAVYYCQQYFINWPPLTFGGGTK<br>VDIK |
| 231 | 3691 | 1723 | RASQSVGSNLA |
| 231 | 3692 | 1724 | AGGGCCAGTCAGAGTGTTGGCAGCAACTTGGCC |
| 231 | 3693 | 1725 | GASTRAT |
| 231 | 3694 | 1726 | GGTGCCTCAACCAGGGCCACT |
| 231 | 3695 | 1727 | QQYFINWPPLT |
| 231 | 3696 | 1728 | CAGCAGTATCATAACTGGCCTCCGCTCACT |
| 232 (ADI-31672) | 5905 | 1729 | CAGGTCCAGCTTGTACAGTCTGGGGCTGAAGTGAAGAGGCCTGGGTCCT<br>CGGTGAAGGTCTCCTGCAAGGCTTCTGGAGGCACCTTCAGCAGCTTTGG<br>GATCAACTGGGTGCGACAGGCCCCTGGACAAGGGCTTGAGTGGATGGGA<br>GGGCTCAATCCTATCTTTGGTACACCATCTAACGCACAGAAGTTCCAGG<br>GCAGAGTCACGATTACCGCGGACGAATCCACGAGCACAGCCTACATGGA<br>GCTGAGCAGCCTGAGATCTGAGGACACGGCCGTCTATTACTGTGCCTCA<br>TTACGATATTTTGACTGGCAACCTGGGGGGTCCTACTGGTTCGACCCCTG<br>GGGCCAGGGAACCCTGGTCACCGTCTCCTCA |
| 232 | 5906 | 1730 | QVQLVQSGAEVKRPGSSVKVSCKASGGTFSSFGINWVRQAPGQGLEWMGG<br>LNPIFGTPSNAQKFQGRVTITADESTSTAYMELSSLRSEDTAVYYCASLRYF<br>DWQPGGSYWFDPWGQGTLVTVSS |
| 232 | 5907 | 1731 | GTFSSFGIN |
| 232 | 5908 | 1732 | GLNPIFGTPSNAQKFQG |
| 232 | 5909 | 1733 | ASLRYFDWQPGGSYWFDP |
| 232 | 5910 | 1734 | CAGCCTGGGCTGACTCAGCCACCCTCAGTGTCAGTGGCCCCAGGAAAGA<br>CGGCCAGGATTGCCTGTGGGGGAGACAACATTGGAACTAAAGGAGTGC<br>ACTGGTACCAGCAGAAGCCAGGCCAGGCCCCTGTGCTGGTCATCTATTA<br>TGATAGCGACCGGCCCTCAGGGATCCCTGAGCGATTCTCTGGTTCCAACT |

TABLE 6-continued

Informal Sequence Listing

| Antibody No. | Seq. Ref. No. | SEQ ID NO. | Sequence |
|---|---|---|---|
| | | | CTGGGAACACGGCCACCCTGACCATCAGCGGGGTCGAAGCCGGGGATG AGGCCGACTACTACTGTCAGGTTTGGGATACTATTGATGATTATAAGGAT GGACTATTCGGCGGAGGGACCAAGCTCACCGTCCTA |
| | 5911 | 1735 | QPGLTQPPSVSVAPGKTARIACGGDNIGTKGVHWYQQKPGQAPVLVIYYDS DRPSGIPERFSGSNSGNTATLTISGVEAGDEADYYCQVWDTIDDYKDGLFGG GTKLTVL |
| | 5912 | 1736 | GGDNIGTKGVH |
| | 5913 | 1737 | YDSDRPS |
| | 5914 | 1738 | QVWDTIDDYKDGL |
| 233 (ADI-31673) | 5915 | 1739 | CAGGTCCAGCTTGTACAGTCTGGGGCTGAAGTGAAGAGGCCTGGGTCCT CGGTGAAGGTCTCCTGCAAGGCTTCTGGAGGCACCTTCAGCAGCTTTGCT ATCCAGTGGGTGCGACAGGCCCCTGGACAAGGGCTTGAGTGGATGGGAG GGCTCATCCCTATCTTTGGTACACCAGAGAACGCACAGAAGTTCCAGGG CAGAGTCACGATTACCGCGGACGAATCCACGAGCACAGCCTACATGGAG CTGAGCAGCCTGAGATCTGAGGACACGGCCGTCTATTACTGTGCCTCATT ACGATATTTTGACTGGCAACCTGGGGGTCCTACTGGTTCGACCCCTGGG GCCAGGGAACCCTGGTCACCGTCTCCTCA |
| | 5916 | 1740 | QVQLVQSGAEVKRPGSSVKVSCKASGGTFSSFAIQWVRQAPGQGLEWMGG LIPIFGTPENAQKFQGRVTITADESTSTAYMELSSLRSEDTAVYYCASLRYFD WQPGGSYWFDPWGQGTLVTVSS |
| | 5917 | 1741 | GTFSSFAIQ |
| | 5918 | 1742 | GLIPIFGTPENAQKFQG |
| | 5919 | 1743 | ASLRYFDWQPGGSYWFDP |
| | 5920 | 1744 | CAGCCTGGGCTGACTCAGCCACCCTCAGTGTCAGTGGCCCCAGGAAAGA CGGCCAGGATTGCCTGTGGGGGAGACAACATTGGAACTAAAGGAGTGC ACTGGTACCAGCAGAAGCCAGGCCAGGCCCCTGTGCTGGTCATCTATTA TGATAGCGACCGGCCCTCAGGGATCCCTGAGCGATTCTCTGGTTCCAACT CTGGGAACACGGCCACCCTGACCATCAGCGGGGTCGAAGCCGGGGATG AGGCCGACTACTACTGTCAGGTTTGGGATACTATTGATGATCATAAGGA TGGACTATTCGGCGGAGGGACCAAGCTCACCGTCCTA |
| | 5921 | 1745 | QPGLTQPPSVSVAPGKTARIACGGDNIGTKGVHWYQQKPGQAPVLVIYYDS DRPSGIPERFSGSNSGNTATLTISGVEAGDEADYYCQVWDTIDDHKDGLFGG GTKLTVL |
| | 5922 | 1746 | GGDNIGTKGVH |
| | 5923 | 1747 | YDSDRPS |
| | 5924 | 1748 | QVWDTIDDHKDGL |
| 234 (ADI-31674) | 5925 | 1749 | GAGGTGCAGCTGTTGGAGTCTGGGGGAGGCGTGGTCCAGCCTGGGAGGT CCCTGAGACTCTCCTGTGCAGCCTCTGGATTCACCTTCAGTGACTTTTCT ATGCACTGGGTCCGCCAGGCTCCAGGCAAGGGGCTGGAGTGGGTGGCAC TCATCTCAAATGATGGAAGCAATAAATATTATTCAGACTCCCTGAAGGG TTCATTCATCATCTCCAGAGACAACTCCAAGAACACGCTCTATCTCCAAC TGAACAGCCTGGGAGCTGAGGACACGGCTCTCTATTACTGTGCGAGAGA TGCGGTTCCCCATTATGATTACGTCTGGGGAAACTTTGACTACTGGGGCC AGGGAACCCTGGTCACTGTCTCCTCA |
| | 5926 | 1750 | EVQLLESGGGVVQPGRSLRLSCAASGFTFSDFSMHWVRQAPGKGLEWVALI SNDGSNKYYSDSLKGSFIISRDNSKNTLYLQLNSLGAEDTALYYCARDAVPH YDYVWGNFDYWGQGTLVTVSS |
| | 5927 | 1751 | FTFSDFSMH |
| | 5928 | 1752 | LISNDGSNKYYSDSLKG |
| | 5929 | 1753 | ARDAVPHYDYVWGNFDY |
| | 5930 | 1754 | GAGGTGCAGCTGTTGGAGTCTGGGGGAGGCGTGGTCCAGCCTGGGAGGT CCCTGAGACTCTCCTGTGCAGCCTCTGGATTCACCTTCAGTGACTTTTCT ATGCACTGGGTCCGCCAGGCTCCAGGCAAGGGGCTGGAGTGGGTGGCAC TCATCTCAAATGATGGAAGCAATAAATATTATTCAGACTCCCTGAAGGG |

TABLE 6-continued

Informal Sequence Listing

| Antibody No. | Seq. Ref. No. | SEQ ID NO. | Sequence |
|---|---|---|---|
| | | | TTCATTCATCATCTCCAGAGACAACTCCAAGAACACGCTCTATCTCCAAC<br>TGAACAGCCTGGGAGCTGAGGACACGGCTCTCTATTACTGTGCGAGAGA<br>TGCGGTTCCCCATTATGATTACGTCTGGGGAAACTTTGACTACTGGGGCC<br>AGGGAACCCTGGTCACTGTCTCCTCA |
| | 5931 | 1755 | EVQLLESGGGVVQPGRSLRLSCAASGFTFSDFSMHWVRQAPGKGLEWVALI<br>SNDGSNKYYSDSLKGSFIISRDNSKNTLYLQLNSLGAEDTALYYCARDAVPH<br>YDYVWGNFDYWGQGTLVTVSS |
| | 5932 | 1756 | TGTASDVGGYNYVS |
| | 5933 | 1757 | EVSNRPS |
| | 5934 | 1758 | SSYTSFTPVV |
| 235 (ADI-31674S 95A) | 5935 | 1759 | GAGGTGCAGCTGTTGGAGTCTGGGGGAGGCGTGGTCCAGCCTGGGAGGT<br>CCCTGAGACTCTCCTGTGCAGCCTCTGGATTCACCTTCAGTGACTTTTCT<br>ATGCACTGGGTCCGCCAGGCTCCAGGCAAGGGGCTGGAGTGGGTGGCAC<br>TCATCTCAAATGATGGAAGCAATAAATATTATTCAGACTCCCTGAAGGG<br>TTCATTCATCATCTCCAGAGACAACTCCAAGAACACGCTCTATCTCCAAC<br>TGAACAGCCTGGGAGCTGAGGACACGGCTCTCTATTACTGTGCGAGAGA<br>TGCGGTTCCCCATTATGATTACGTCTGGGGAAACTTTGACTACTGGGGCC<br>AGGGAACCCTGGTCACTGTCTCCTCA |
| | 5936 | 1760 | EVQLLESGGGVVQPGRSLRLSCAASGFTFSDFSMHWVRQAPGKGLEWVALI<br>SNDGSNKYYSDSLKGSFIISRDNSKNTLYLQLNSLGAEDTALYYCARDAVPH<br>YDYVWGNFDYWGQGTLVTVSS |
| | 5937 | 1761 | FTFSDFSMH |
| | 5938 | 1762 | LISNDGSNKYYSDSLKG |
| | 5939 | 1763 | ARDAVPHYDYVWGNFDY |
| | 5940 | 1764 | CAGTCTGTTCTGACTCAGCCTGCCTCCGTGTCTGCGTCTCCTGGACAGTC<br>GATCACCATCTCCTGCACTGGAACCGCGAGTGACGTTGGTGGTTATAATT<br>ATGTCTCCTGGTACCAACAGCACCCAGGCAAAGCCCCCAAACTCATAAT<br>TTATGAGGTCAGTAATCGGCCCTCAGGGGTTTCTAATCGCTTCTCTGGCT<br>CCAAGTCTGGCAACACGGCCTCCCTGACCATCTCTGGGCTCCAGGCTGA<br>CGACGAGGCTGATTATTACTGCAGCTCATATACAGCTTTCACTCCCGTGG<br>TATTCGGCGGAGGGACCAAGCTGACCGTCCTA |
| | 5941 | 1765 | QSVLTQPASVSASPGQSITISCTGTASDVGGYNYVSWYQQHPGKAPKLIIYE<br>VSNRPSGVSNRFSGSKSGNTASLTISGLQADDEADYYCSSYTAFTPVVFGGG<br>TKLTVL |
| | 5942 | 1766 | TGTASDVGGYNYVS |
| | 5943 | 1767 | EVSNRPS |
| | 5944 | 1768 | SSYTAFTPVV |
| 236 (ADI-31675) | 5945 | 1769 | GAGGTGCAGCTGTTGGAGTCTGGGGGAGGCGTGGTCCAGCCTGGGAGGT<br>CCCTGAGACTCTCCTGTGCAGCCTCTGGATTCACCTTCAGTGACTTTTCT<br>ATGCACTGGGTCCGCCAGGCTCCAGGCAAGGGGCTGGAGTGGGTGGCAC<br>TCATCTCAAATGATGGAAGCAATAAATATTATTCAGACTCCCTGAAGGG<br>TTCATTCATCATCTCCAGAGACAACTCCAAGAACACGCTCTATCTCCAAC<br>TGAACAGCCTGGGAGCTGAGGACACGGCTCTCTATTACTGTGCGAGAGA<br>TGCGGTTCCCCATTATGATTACGTCTGGGGAAACTTTGACTACTGGGGCC<br>AGGGAACCCTGGTCACTGTCTCCTCA |
| | 5946 | 1770 | EVQLLESGGGVVQPGRSLRLSCAASGFTFSDFSMHWVRQAPGKGLEWVALI<br>SNDGSNKYYSDSLKGSFIISRDNSKNTLYLQLNSLGAEDTALYYCARDAVPH<br>YDYVWGNFDYWGQGTLVTVSS |
| | 5947 | 1771 | FTFSDFSMH |
| | 5948 | 1772 | LISNDGSNKYYSDSLKG |
| | 5949 | 1773 | ARDAVPHYDYVWGNFDY |
| | 5950 | 1774 | CAGTCTGTTCTGACTCAGCCTGCCTCCGTGTCTGCGTCTCCTGGACAGTC<br>GATCACCATCTCCTGCACTGGAACCGCGAGTGACGTTGGTGGTTATAATT<br>ATGTCTCCTGGTACCAACAGCACCCAGGCAAAGCCCCCAAACTCATAAT |

TABLE 6-continued

Informal Sequence Listing

| Antibody No. | Seq. Ref. No. | SEQ ID NO. | Sequence |
|---|---|---|---|
| | | | TTATGAGAAGAGTAATCGGCCCTCAGGGGTTTCTAATCGCTTCTCTGGCT<br>CCAAGTCTGGCAACACGGCCTCCCTGACCATCTCTGGGCTCCAGGCTGA<br>CGACGAGGCTGATTATTACTGCAGCTCATATACAAGTTTCACTCCCGTGG<br>TATTCGGCGGAGGGACCAAGCTGACCGTCCTA |
| | 5951 | 1775 | QSVLTQPASVSASPGQSITISCTGTASDVGGYNYVSWYQQHPGKAPKLIIYE<br>KSNRPSGVSNRFSGSKSGNTASLTISGLQADDEADYYCSSYTSFTPVVFGGG<br>TKLTVL |
| | 5952 | 1776 | TGTASDVGGYNYVS |
| | 5953 | 1777 | EKSNRPS |
| | 5954 | 1778 | SSYTSFTPVV |
| 237<br>(ADI-<br>31378) | 5955 | 1779 | CAGGTCCAGCTGGTACAGTCTGGGGGAGGCCTGGTCAAGCCTGGGGGGT<br>CCCTGAGACTCTCTTGTGCAGCCTCTGGATTCACCTTCAGTAGCTATACC<br>ATGAACTGGGTCCGCCAGGCTCCAGGGAAGGGGCTGGAGTGGGTCTCAT<br>CCATTACTGGTGGTAGTAGTTTCACAAACTACGCAGACTCACTGGAGGG<br>CCGATTCACCATCTCCAGAGATAACGCCAAGAGCTCACTTTTTCTGCAAA<br>TGAACAGCCTGAGAGTCGAGGACACGGCTGTATATTACTGTGCGAGAGA<br>TCAGCCGGGGACGATTTTTGGAGTGGTCCAGGACTACTGGGGCCAGGGA<br>ACCCTGGTCACCGTCTCCTCA |
| | 5956 | 1780 | QVQLVQSGGGLVKPGGSLRLSCAASGFTFSSYTMNWVRQAPGKGLEWVSS<br>ITGGSSFTNYADSLEGRFTISRDNAKSSLFLQMNSLRVEDTAVYYCARDQPG<br>TIFGVVQDYWGQGTLVTVSS |
| | 5957 | 1781 | FTFSSYTMN |
| | 5958 | 1782 | SITGGSSFTNYADSLEG |
| | 5959 | 1783 | ARDQPGTIFGVVQDY |
| | 5960 | 1784 | CAGTCTGTCTTGACGCAGCCGCCCTCAGTGTCTGGGGCCCCAGGGCAGA<br>GGGTCACCATCTCCTGCACTGGGGGCAGCTCCAACATCGGGGCAGGTTA<br>TGATGTGCACTGGTACCAGCAGCTTCCAGGAACAGCCCCTAAACTCCTC<br>ATCTATGGTAACAGCAATCGGGGTCAGGGGTCCCTGACCGATTCTCTG<br>GCTCCAAGTCTGGCACCTCAGCCTCCCTGGCCATCACTGGGCTCCAGGCT<br>GAGGATGAGGCTGATTATTACTGCCAGTCCTATGACAGCCGCCTGCAGG<br>TGGTATTCGGCGGAGGGACCAAGGTGACCGTCCTA |
| | 5961 | 1785 | QSVLTQPPSVSGAPGQRVTISCTGGSSNIGAGYDVHWYQQLPGTAPKLLIYG<br>NSNRGSGVPDRFSGSKSGTSASLAITGLQAEDEADYYCQSYDSRLQVVFGG<br>GTKVTVL |
| | 5962 | 1786 | TGGSSNIGAGYDVH |
| | 5963 | 1787 | GNSNRGS |
| | 5964 | 1788 | QSYDSRLQVV |
| 238<br>(ADI-<br>31379) | 5965 | 1789 | CAGGTCCAGCTGGTACAGTCTGGGGGAGGCCTGGTCAAGCCTGGGGGGT<br>CCCTGAGACTCTCTTGTGCAGCCTCTGGATTCACCTTCAGTAGCTATACC<br>ATGAACTGGGTCCGCCAGGCTCCAGGGAAGGGGCTGGAGTGGGTCTCAT<br>CCATTACTGGTGGTAGTAGTTTCACAAACTACGCAGACTCACTGGAGGG<br>CCGATTCACCATCTCCAGAGATAACGCCAAGAGCTCACTTTTTCTGCAAA<br>TGAACAGCCTGAGAGTCGAGGACACGGCTGTATATTACTGTGCGAGAGA<br>TCAGCCGGGGACGATTTTTGGAGTGGTCCAGGACTACTGGGGCCAGGGA<br>ACCCTGGTCACCGTCTCCTCA |
| | 5966 | 1790 | QVQLVQSGGGLVKPGGSLRLSCAASGFTFSSYTMNWVRQAPGKGLEWVSS<br>ITGGSSFTNYADSLEGRFTISRDNAKSSLFLQMNSLRVEDTAVYYCARDQPG<br>TIFGVVQDYWGQGTLVTVSS |
| | 5967 | 1791 | FTFSSYTMN |
| | 5968 | 1792 | SITGGSSFTNYADSLEG |
| | 5969 | 1793 | ARDQPGTIFGVVQDY |
| | 5970 | 1794 | CAGTCTGTCTTGACGCAGCCGCCCTCAGTGTCTGGGGCCCCAGGGCAGA<br>GGGTCACCATCTCCTGCACTGGGGGCAGCTCCAACATCGGGAAGGGTTA<br>TGATGTGCACTGGTACCAGCAGCTTCCAGGAACAGCCCCCAAACTCCTC |

TABLE 6-continued

Informal Sequence Listing

| Antibody No. | Seq. Ref. No. | SEQ ID NO. | Sequence |
|---|---|---|---|
| | | | ATCTATGGTAACAGCAATCGGCCCGGGGGGTCCCTGACCGATTCTCTG<br>GCTCCAAGTCTGGCACCTCAGCCTCCCTGGCCATCACTGGGCTCCAGGCT<br>GAGGATGAGGCTGATTATTACTGCCAGTCCTATGACAGCGGGCTGAGTG<br>TGGTATTCGGCGGAGGGACCAAGGTGACCGTCCTA |
| | 5971 | 1795 | QSVLTQPPSVSGAPGQRVTISCTGGSSNIGKYDVHWYQQLPGTAPKLLIYG<br>NSNRPGGVPDRFSGSKSGTSASLAITGLQAEDEADYYCQSYDSGLSVVFGG<br>GTKVTVL |
| | 5972 | 1796 | TGGSSNIGKYDVH |
| | 5973 | 1797 | GNSNRPG |
| | 5974 | 1798 | QSYDSGLSVV |
| 239 (ADI-31380) | 5975 | 1799 | CAGGTCCAGCTGGTACAGTCTGGGGGAGGCCTGGTCAAGCCTGGGGGGT<br>CCCTGAGACTCTCTTGTGCAGCCTCTGGATTCAAGTTCAGTAGCTATACC<br>ATGAACTGGGTCCGCCAGGCTCCAGGGAAGGGGCTGGAGTGGGTCTCAT<br>CCATTACTGGTGGTAGTAGTTTCACAAACTACGCAGACTCACTGGAGGG<br>CCGATTCACCATCTCCAGAGATAACGCCAAGAGCTCACTTTTTCTGCAAA<br>TGAACAGCCTGAGAGTCGAGGACACGGCTGTATATTACTGTGCGAGAGA<br>TCAGCCGGGGACGATTTTTGGAGTGGTCCAGGACTACTGGGGCCAGGGA<br>ACCCTGGTCACCGTCTCCTCA |
| | 5976 | 1800 | QVQLVQSGGGLVKPGGSLRLSCAASGFKFSSYTMNWVRQAPGKGLEWVSS<br>ITGGSSFTNYADSLEGRFTISRDNAKSSLFLQMNSLRVEDTAVYYCARDQPG<br>TIFGVVQDYWGQGTLVTVSS |
| | 5977 | 1801 | FKFSSYTMN |
| | 5978 | 1802 | SITGGSSFTNYADSLEG |
| | 5979 | 1803 | ARDQPGTIFGVVQDY |
| | 5980 | 1804 | CAGTCTGTCTTGACGCAGCCGCCCTCAGTGTCTGGGGCCCCAGGGCAGA<br>GGGTCACCATCTCCTGCACTGGGGGCAGCTCCAACATCGGGGCAGGTTA<br>TGATGTGCACTGGTACCAGCAGCTTCCAGGAACAGCCCCCAAACTCCTC<br>ATCTATGGTAACAGCAATCGGCCCTCAGGGGTCCCTGACCGATTCTCTGG<br>CTCCAAGTCTGGCACCTCAGCCTCCCTGGCCATCACTGGGCTCCAGGCTG<br>AGGATGAGGCTGATTATTACTGCCAGTCCTATGACAGCCGCCTGAGTGT<br>GGTATTCGGCGGAGGGACCAAGGTGACCGTCCTA |
| | 5981 | 1805 | QSVLTQPPSVSGAPGQRVTISCTGGSSNIGAGYDVHWYQQLPGTAPKLLIYG<br>NSNRPSGVPDRFSGSKSGTSASLAITGLQAEDEADYYCQSYDSRLSVVFGGG<br>TKVTVL |
| | 5982 | 1806 | TGGSSNIGAGYDVH |
| | 5983 | 1807 | GNSNRPS |
| | 5984 | 1808 | QSYDSRLSVV |
| 240 (ADI-31381) | 5985 | 1809 | CAGGTCCAGCTGGTACAGTCTGGGGGAGGCCTGGTCAAGCCTGGGGGGT<br>CCCTGAGACTCTCTTGTGCAGCCTCTGGATTCAGCTTCAGTAGCTATAGC<br>ATGAACTGGGTCCGCCAGGCTCCAGGGAAGGGGCTGGAGTGGGTCTCAT<br>CCATTACTGGTGGTAGTAGTTTCGTTAACTACGCAGACTCACTGGAGGGC<br>CGATTCACCATCTCCAGAGATAACGCCAAGAGCTCACTTTTTCTGCAAAT<br>GAACAGCCTGAGAGTCGAGGACACGGCTGTATATTACTGTGCGAGAGAT<br>CAGCCGGGGACGATTTTTGGAGTGGTCCAGGACTACTGGGGCCAGGGAA<br>CCCTGGTCACCGTCTCCTCA |
| | 5986 | 1810 | QVQLVQSGGGLVKPGGSLRLSCAASGFSFSSYSMNWVRQAPGKGLEWVSSI<br>TGGSSFVNYADSLEGRFTISRDNAKSSLFLQMNSLRVEDTAVYYCARDQPG<br>TIFGVVQDYWGQGTLVTVSS |
| | 5987 | 1811 | FSFSSYSMN |
| | 5988 | 1812 | SITGGSSFVNYADSLEG |
| | 5989 | 1813 | ARDQPGTIFGVVQDY |
| | 5990 | 1814 | CAGTCTGTCTTGACGCAGCCGCCCTCAGTGTCTGGGGCCCCAGGGCAGA<br>GGGTCACCATCTCCTGCACTGGGGGCAGCTCCAACATCGGGGCAGGTTA<br>TGATGTGCACTGGTACCAGCAGCTTCCAGGAACAGCCCCCAAACTCCTC |

TABLE 6-continued

Informal Sequence Listing

| Antibody No. | Seq. Ref. No. | SEQ ID NO. | Sequence |
|---|---|---|---|
| | | | ATCTATGGTAACAGCAATCGGCCCTCAGGGGTCCCTGACCGATTCTCTGG<br>CTCCAAGTCTGGCACCTCAGCCTCCCTGGCCATCACTGGGCTCCAGGCTG<br>AGGATGAGGCTGATTATTACTGCCAGTCCTATGACAGCCGCCTGAGTGT<br>GGTATTCGGCGGAGGGACCAAGGTGACCGTCCTA |
| | 5991 | 1815 | QSVLTQPPSVSGAPGQRVTISCTGGSSNIGAGYDVHWYQQLPGTAPKLLIYG<br>NSNRPSGVPDRFSGSKSGTSASLAITGLQAEDEADYYCQSYDSRLSVVFGGG<br>TKVTVL |
| | 5992 | 1816 | TGGSSNIGAGYDVH |
| | 5993 | 1817 | GNSNRPS |
| | 5994 | 1818 | QSYDSRLSVV |
| 241 (ADI-31312) | 5995 | 1819 | CAGGTCCAGCTGGTACAGTCTGGGGGAGGCCTGGTCAAGCCTGGGGGGT<br>CCCTGAGACTCTCTTGTGCAGCCTCTGGATTCAAGTTCAGTAGCTATACC<br>ATGAACTGGGTCCGCCAGGCTCCAGGGAAGGGGCTGGAGTGGGTCTCAT<br>CCATTACTGGTGGTAGTAGTTTCACAAACTACGCAGACTCACTGGAGGG<br>CCGATTCACCATCTCCAGAGATAACGCCAAGAGCTCACTTTTTCTGCAAA<br>TGAACAGCCTGAGAGTCGAGGACACGGCTGTATATTACTGTGCGAGAGA<br>TCAGCCGGGGACGATTTTTGGAGTGGTCCAGGACTACTGGGGCCAGGGA<br>ACCCTGGTCACCGTCTCCTCA |
| | 5996 | 1820 | QVQLVQSGGGLVKPGGSLRLSCAASGFKFSSYTMNWVRQAPGKGLEWVSS<br>ITGGSSFTNYADSLEGRFTISRDNAKSSLFLQMNSLRVEDTAVYYCARDQPG<br>TIFGVVQDYWGQGTLVTVSS |
| | 5997 | 1821 | FKFSSYTMN |
| | 5998 | 1822 | SITGGSSFTNYADSLEG |
| | 5999 | 1823 | ARDQPGTIFGVVQDY |
| | 6000 | 1824 | CAGTCTGTCTTGACGCAGCCGCCCTCAGTGTCTGGGGCCCCAGGGCAGA<br>GGGTCACCATCTCCTGCACTGGGGGCAGCTCCAACATCGGGGCAGGTTA<br>TGATGTGCACTGGTACCAGCAGCTTCCAGGAACAGCCCCTAAACTCCTC<br>ATCTATGGTAACAGCAATCGGGGGTCAGGGGTCCCTGACCGATTCTCTG<br>GCTCCAAGTCTGGCACCTCAGCCTCCCTGGCCATCACTGGGCTCCAGGCT<br>GAGGATGAGGCTGATTATTACTGCCAGTCCTATGACAGCCGCCTGCAGG<br>TGGTATTCGGCGGAGGGACCAAGGTGACCGTCCTA |
| | 6001 | 1825 | QSVLTQPPSVSGAPGQRVTISCTGGSSNIGAGYDVHWYQQLPGTAPKLLIYG<br>NSNRGSGVPDRFSGSKSGTSASLAITGLQAEDEADYYCQSYDSRLQVVFGG<br>GTKVTVL |
| | 6002 | 1826 | TGGSSNIGAGYDVH |
| | 6003 | 1827 | GNSNRGS |
| | 6004 | 1828 | QSYDSRLQVV |
| 242 (ADI-31319) | 6005 | 1829 | CAGGTCCAGCTGGTACAGTCTGGGGGAGGCCTGGTCAAGCCTGGGGGGT<br>CCCTGAGACTCTCTTGTGCAGCCTCTGGATTCAAGTTCAGTAGCTATACC<br>ATGAACTGGGTCCGCCAGGCTCCAGGGAAGGGGCTGGAGTGGGTCTCAT<br>CCATTACTGGTGGTAGTAGTTTCACAAACTACGCAGACTCACTGGAGGG<br>CCGATTCACCATCTCCAGAGATAACGCCAAGAGCTCACTTTTTCTGCAAA<br>TGAACAGCCTGAGAGTCGAGGACACGGCTGTATATTACTGTGCGAGAGA<br>TCAGCCGGGGACGATTTTTGGAGTGGTCCAGGACTACTGGGGCCAGGGA<br>ACCCTGGTCACCGTCTCCTCA |
| | 6006 | 1830 | QVQLVQSGGGLVKPGGSLRLSCAASGFKFSSYTMNWVRQAPGKGLEWVSS<br>ITGGSSFTNYADSLEGRFTISRDNAKSSLFLQMNSLRVEDTAVYYCARDQPG<br>TIFGVVQDYWGQGTLVTVSS |
| | 6007 | 1831 | FKFSSYTMN |
| | 6008 | 1832 | SITGGSSFTNYADSLEG |
| | 6009 | 1833 | ARDQPGTIFGVVQDY |
| | 6010 | 1834 | CAGTCTGTCTTGACGCAGCCGCCCTCAGTGTCTGGGGCCCCAGGGCAGA<br>GGGTCACCATCTCCTGCACTGGGGGCAGCTCCAACATCGGGAAGGGTTA<br>TGATGTGCACTGGTACCAGCAGCTTCCAGGAACAGCCCCCAAACTCCTC |

TABLE 6-continued

Informal Sequence Listing

| Antibody No. | Seq. Ref. No. | SEQ ID NO. | Sequence |
|---|---|---|---|
| | | | ATCTATGGTAACAGCAATCGGCCCGGGGGGTCCCTGACCGATTCTCTG<br>GCTCCAAGTCTGGCACCTCAGCCTCCCTGGCCATCACTGGGCTCCAGGCT<br>GAGGATGAGGCTGATTATTACTGCCAGTCCTATGACAGCGGGCTGAGTG<br>TGGTATTCGGCGGAGGGACCAAGGTGACCGTCCTA |
| | 6011 | 1835 | QSVLTQPPSVSGAPGQRVTISCTGGSSNIGKYDVHWYQQLPGTAPKLLIYG<br>NSNRPGGVPDRFSGSKSGTSASLAITGLQAEDEADYYCQSYDSGLSVVFGG<br>GTKVTVL |
| | 6012 | 1836 | TGGSSNIGKYDVH |
| | 6013 | 1837 | GNSNRPG |
| | 6014 | 1838 | QSYDSGLSVV |
| 243<br>(ADI-<br>31328) | 6015 | 1839 | CAGGTCCAGCTGGTACAGTCTGGGGGAGGCCTGGTCAAGCCTGGGGGGT<br>CCCTGAGACTCTCTTGTGCAGCCTCTGGATTCAGCTTCAGTAGCTATAGC<br>ATGAACTGGGTCCGCCAGGCTCCAGGGAAGGGGCTGGAGTGGGTCTCAT<br>CCATTACTGGTGGTAGTAGTTTCGTTAACTACGCAGACTCACTGGAGGGC<br>CGATTCACCATCTCCAGAGATAACGCCAAGAGCTCACTTTTTCTGCAAAT<br>GAACAGCCTGAGAGTCGAGGACACGGCTGTATATTACTGTGCGAGAGAT<br>CAGCCGGGGACGATTTTTGGAGTGGTCCAGGACTACTGGGGCCAGGGAA<br>CCCTGGTCACCGTCTCCTCA |
| | 6016 | 1840 | QVQLVQSGGGLVKPGGSLRLSCAASGFSFSSYSMNWVRQAPGKGLEWVSSI<br>TGGSSFVNYADSLEGRFTISRDNAKSSLFLQMNSLRVEDTAVYYCARDQPG<br>TIFGVVQDYWGQGTLVTVSS |
| | 6017 | 1841 | FSFSSYSMN |
| | 6018 | 1842 | SITGGSSFVNYADSLEG |
| | 6019 | 1843 | ARDQPGTIFGVVQDY |
| | 6020 | 1844 | CAGTCTGTCTTGACGCAGCCGCCCTCAGTGTCTGGGGCCCCAGGGCAGA<br>GGGTCACCATCTCCTGCACTGGGGGCAGCTCCAACATCGGGGGCAGGTTA<br>TGATGTGCACTGGTACCAGCAGAATCCAGGAACAGCCCCTAAACTCCTC<br>ATCTATGGTAACAGCAATCGGGGGTCAGGGGTCCCTGACCGATTCTCTG<br>GCTCCAAGTCTGGCACCTCAGCCTCCCTGGCCATCACTGGGCTCCAGGCT<br>GAGGATGAGGCTGATTATTACTGCCAGTCCTATGACAGCCGCCTGCAGG<br>TGGTATTCGGCGGAGGGACCAAGGTGACCGTCCTA |
| | 6021 | 1845 | QSVLTQPPSVSGAPGQRVTISCTGGSSNIGAGYDVHWYQQNPGTAPKWYG<br>NSNRGSGVPDRFSGSKSGTSASLAITGLQAEDEADYYCQSYDSRLQVVFGG<br>GTKVTVL |
| | 6022 | 1846 | TGGSSNIGAGYDVH |
| | 6023 | 1847 | GNSNRGS |
| | 6024 | 1848 | QSYDSRLQVV |
| 244<br>(ADI-<br>31330) | 6025 | 1849 | CAGGTCCAGCTGGTACAGTCTGGGGGAGGCCTGGTCAAGCCTGGGGGGT<br>CCCTGAGACTCTCTTGTGCAGCCTCTGGATTCAGCTTCAGTAGCTATAGC<br>ATGAACTGGGTCCGCCAGGCTCCAGGGAAGGGGCTGGAGTGGGTCTCAT<br>CCATTACTGGTGGTAGTAGTTTCGTTAACTACGCAGACTCACTGGAGGGC<br>CGATTCACCATCTCCAGAGATAACGCCAAGAGCTCACTTTTTCTGCAAAT<br>GAACAGCCTGAGAGTCGAGGACACGGCTGTATATTACTGTGCGAGAGAT<br>CAGCCGGGGACGATTTTTGGAGTGGTCCAGGACTACTGGGGCCAGGGAA<br>CCCTGGTCACCGTCTCCTCA |
| | 6026 | 1850 | QVQLVQSGGGLVKPGGSLRLSCAASGFSFSSYSMNWVRQAPGKGLEWVSSI<br>TGGSSFVNYADSLEGRFTISRDNAKSSLFLQMNSLRVEDTAVYYCARDQPG<br>TIFGVVQDYWGQGTLVTVSS |
| | 6027 | 1851 | FSFSSYSMN |
| | 6028 | 1852 | SITGGSSFVNYADSLEG |
| | 6029 | 1853 | ARDQPGTIFGVVQDY |
| | 6030 | 1854 | CAGTCTGTCTTGACGCAGCCGCCCTCAGTGTCTGGGGCCCCAGGGCAGA<br>GGGTCACCATCTCCTGCACTGGGGGCAGCTCCAACATCGGGAAGGGTTA<br>TGATGTGCACTGGTACCAGCAGCTTCCAGGAACAGCCCCCAAACTCCTC |

TABLE 6-continued

Informal Sequence Listing

| Antibody No. | Seq. Ref. No. | SEQ ID NO. | Sequence |
|---|---|---|---|
| | | | ATCTATGGTAACAGCAATCGGCCCGGGGGGTCCCTGACCGATTCTCTG GCTCCAAGTCTGGCACCTCAGCCTCCCTGGCCATCACTGGGCTCCAGGCT GAGGATGAGGCTGATTATTACTGCCAGTCCTATGACAGCGGGCTGAGTG TGGTATTCGGCGGAGGGACCAAGGTGACCGTCCTA |
| | 6031 | 1855 | QSVLTQPPSVSGAPGQRVTISCTGGSSNIGKGYDVHWYQQLPGTAPKLLIYG NSNRPGGVPDRFSGSKSGTSASLAITGLQAEDEADYYCQSYDSGLSVVFGG GTKVTVL |
| | 6032 | 1856 | TGGSSNIGKGYDVH |
| | 6033 | 1857 | GNSNRPG |
| | 6034 | 1858 | QSYDSGLSVV |

ADDITIONAL EMBODIMENTS

Embodiment 1. An isolated antibody or an antigen-binding fragment thereof that specifically binds to Respiratory Syncytial Virus (RSV) F protein (F), wherein at least one of the CDRH1, a CDRH2, a CDRH3, a CDRL1, a CDRL2, and CDRL3 amino acid sequence of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to at least one the CDRH1, a CDRH2, a CDRH3, a CDRL1, a CDRL2, and/or a CDRL3 amino acid sequences as disclosed in Table 6 of an antibody selected from Antibody Number 124 through Antibody Number 244 as disclosed in Table 6; and wherein said antibody or the antigen-binding fragment thereof also has one or more of the following characteristics:

a) the antibody or antigen-binding fragment thereof cross-competes with said antibody or antigen-binding fragment thereof for binding to RSV-F;

b) the antibody or antigen-binding fragment thereof displays better binding affinity for the PreF form of RSV-F relative to the PostF form;

c) the antibody or antigen-binding fragment thereof displays a clean or low polyreactivity profile;

d) the antibody or antigen-binding fragment thereof displays neutralization activity toward RSV suptype A and RSV subtype B in vitro;

e) the antibody or antigen-binding fragment thereof displays antigenic site specificity for RSV-F at Site Ø, Site I, Site II, Site III, Site IV, or Site V;

f) the antibody or antigen-binding fragment thereof displays antigenic site specificity for RSV-F Site Ø, Site V, or Site III relative to RSV-F Site I, Site II, or Site IV;

g) at least a portion of the epitope with which the antibody or antigen-binding fragment thereof interacts comprises the α3 helix and β3/β4 hairpin of PreF;

h) the antibody or antigen-binding fragment thereof displays an in vitro neutralization potency ($IC_{50}$) of between about 0.5 microgram/milliliter (ug/ml) to about 5 ug/ml; between about 0.05 ug/ml to about 0.5 ug/ml; or less than about 0.05 mg/ml;

i) the binding affinity and/or epitopic specificity of the antibody or antigen-binding fragment thereof for any one of the RSV-F variants designated as 1, 2, 3, 4, 5, 6, 7, 8, 9, and DG in FIG. 7A is reduced or eliminated relative to the binding affinity and/or epitopic specificity of said antibody or antigen-binding fragment thereof for the RSV-F or RSV-F DS-Cav1;

j) the antibody or antigen-binding fragment thereof of displays a cross-neutralization potency ($IC_{50}$) against human metapneumovirus (HMPV);

k) the antibody or antigen-binding fragment thereof does not complete with D25, MPEG, palivizumab, or motavizumab; or l) the the antibody or antigen-binding fragment thereof displays at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC50) than D25 and/or palivizumab.

Embodiment 2. The isolated antibody or antigen-binding fragment thereof of Embodiment 1, wherein the antibody or antigen-binding fragment thereof comprises: at least two; at least three; at least 4; at least 5; at least 6; at least 7; at least 8; at least 9; at least 10; at least 11; or at least 12; of characteristics a) through l).

Embodiment 3. The isolated antibody or antigen-binding fragment thereof of Embodiment 1 or 2, wherein the antibody or antigen-binding fragment thereof comprises:

a) the CDRH3 amino acid sequence of any one of the antibodies designated Antibody Number 124 through Antibody Number 244 as disclosed in Table 6;

b) the CDRH2 amino acid sequence of any one of the antibodies designated Antibody Number 124 through Antibody Number 244 as disclosed in Table 6;

c) the CDRH1 amino acid sequence of any one of the antibodies designated Antibody Number 124 through Antibody Number 244 as disclosed in Table 6;

d) the CDRL3 amino acid sequence of any one of the antibodies designated Antibody Number 124 through Antibody Number 244 as disclosed in Table 6;

e) the CDRL2 amino acid sequence of any one of the antibodies designated Antibody Number 124 through Antibody Number 244 as disclosed in Table 6;

f) the CDRL1 amino acid sequence of any one of the antibodies designated Antibody Number 124 through Antibody Number 244 as disclosed in Table 6; or g) any combination of two or more of a), b), c), d), e), and f).

Embodiment 4. The isolated antibody or antigen-binding fragment thereof of any one of Embodiments 1 through 3, wherein the antibody or antigen-binding fragment thereof comprises:

a) a heavy chain (HC) amino acid sequence of any one of the antibodies designated Antibody Number 124 through Antibody Number 244 as disclosed in Table 6; and/or b) a light chain (LC) amino acid sequence of any one of the antibodies designated Antibody Number 124 through Antibody Number 244 as disclosed in Table 6.

Embodiment 5. The isolated antibody or antigen-binding fragment thereof of any one of Embodiments 1 through 4, wherein the antibody is selected from the group consisting antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 124 through Antibody Number 244 as disclosed in Table 6.

Embodiment 6. The isolated antibody or antigen-binding fragment thereof of any one of Embodiments 1 through 5, wherein the antibody is selected from the group consisting of the antibodies designated as Antibody Number 124 through Antibody Number 244 as disclosed in Table 6.

Embodiment 7. An isolated nucleic acid sequence encoding an antibody or antigen-binding fragment thereof according to any one of Embodiments 1 through 6.

Embodiment 8. An expression vector comprising the isolated nucleic acid sequence according to Embodiment 7.

Embodiment 9. A host cell transfected, transformed, or transduced with the nucleic acid sequence according to Embodiment 7 or the expression vector according to Embodiment 8.

Embodiment 10. A pharmaceutical composition comprising: one or more of the isolated antibodies or antigen-binding fragments thereof according to any one of Embodiments 1 through 6; and a pharmaceutically acceptable carrier and/or excipient.

Embodiment 11. A pharmaceutical composition comprising: one or more nucleic acid sequences according to Embodiment 7; or one or more the expression vectors according to Embodiment 8; and a pharmaceutically acceptable carrier and/or excipient.

Embodiment 12. A transgenic organism comprising the nucleic acid sequence according to Embodiment 7; or the expression vector according to Embodiment 8.

Embodiment 13. A method of treating or preventing a Respiratory Syncytial Virus (RSV) infection, ar at least one symptom associated with RSV infection, comprising administering to a patient in need thereof or suspected of being in need thereof:

a) one or more antibodies or antigen-binding fragments thereof according to any of Embodiments 1 through 6;

b) a nucleic acid sequences according to Embodiment 7;

c) an expression vector according to Embodiment 8;

d) a host cell according to Embodiment 9; or e) a pharmaceutical composition according Embodiment 10 or Embodiment 11; such that the RSV infection is treated or prevented, or the at least on symptom associated with RSV infection is treated, alleviated, or reduced in severity.

Embodiment 14. A method of treating or preventing either a Respiratory Syncytial Virus (RSV) infection or a human metapneumovirus (HMPV) infection, ar at least one symptom associated with said RSV infection or said HMPV infection, comprising administering to a patient in need thereof or suspected of being in need thereof:

a) one or more antibodies or antigen-binding fragments thereof according to any of Embodiments 1 through 6;

b) a nucleic acid sequences according to Embodiment 7;

c) an expression vector according to Embodiment 8;

d) a host cell according to Embodiment 9; or e) a pharmaceutical composition according Embodiment 10 or Embodiment 11; such that the RSV infection is treated or prevented, or the at least on symptom associated with RSV infection is treated, alleviated, or reduced in severity.

Embodiment 15. The method according to Embodiment 14, wherein the one or more antibodies or antigen-binding fragments thereof of a) is selected from the group consisting of the antibodies desifgnated as Antibody Number 179, 188, 211, 221, or 229 as disclosed in Table 6.

Embodiment 16. The method according to any one of Embodiments 13 through 15, wherein the method further comprises administering to the patient a second therapeutic agent.

Embodiment 17. The method according to Embodiment 16, wherein the second therapeutic agent is selected group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

Embodiment 18. A pharmacuetical composition comprising any one or more of the isolated antibodies or antigen-binding fragments thereof of any one of Embodiments 1 through 7 and a pharmaceutically acceptable carrier and/oror excipient.

Embodiment 19. The pharmaceutical composition according to Embodiment 18 for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

Embodiment 20. The pharmaceutical composition according to Embodiment 18 for us in treating or preventing either a Respiratory Syncytial Virus (RSV) infection or a human metapneumovirus (HMPV) infection, ar at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

Embodiment 21. Use of the pharmaceutical composition of Embodiment 18 in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

Embodiment 22. Use of the pharmaceutical composition of Embodiment 18 in the manufacture of a medicament for preventing either a Respiratory Syncytial Virus (RSV) infection or a human metapneumovirus (HMPV) infection, ar at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

SEQUENCE LISTING (1858 sequences)

SEQ ID NO: 1 - DNA, 378 bp, Artificial Sequence
  source: /note="Description of Artificial Sequence: Synthetic heavy chain variable region"
caggtgcagctggtggagtctggtcctgcgctggtgaaacccacacagaccctcacactgacctgcagcttctccgggttctcactcaccactaggagaatgtgtgtgagctggatccgtcagaccccagggaaggccctggagtggcttgcacgcattgattgggatgatgataaagactacagcacatctctgaagaccaggctcaccatctccaaggacacctccaaaaaccaggtggtccttacaatgaccaacatggaccctgtggacacggccacgtattactgtgcacggacccacatttatgatagtagtggttattatctatactactttgactactggggccagggaaccctggtcaccgtctcttca

SEQ ID NO: 2 - protein, 126 aa, Artificial Sequence
  source: /note="Description of Artificial Sequence: Synthetic heavy chain variable region"
QVQLVESGPALVKPTQTLTLTCSFSGFSLTTRRMCVSWIRQTPGKALEWLARIDWDDDKDYSTSLKTRLTISKDTSKNQVVLTMTNMDPVDTATYYCARTHIYDSSGYYLYYFDYWGQGTLVTVSS

SEQ ID NO: 3 - protein, 11 aa, Artificial Sequence
  source: /note="Description of Artificial Sequence: Synthetic heavy chain variable region CDR H1"
FSLTTRRMCVS

SEQ ID NO: 4 - DNA, 33 bp, Artificial Sequence
  source: /note="Description of Artificial Sequence: Synthetic heavy chain variable region CDR H1"
ttctcactcaccactaggagaatgtgtgtgagc

SEQ ID NO: 5 - protein, 16 aa, Artificial Sequence
  source: /note="Description of Artificial Sequence: Synthetic heavy chain variable region CDR H2"
RIDWDDDKDYSTSLKT

SEQ ID NO: 6 - DNA, 48 bp, Artificial Sequence
  source: /note="Description of Artificial Sequence: Synthetic heavy chain variable region CDR H2"
cgcattgattgggatgatgataaagactacagcacatctctgaagacc

SEQ ID NO: 7 - protein, 18 aa, Artificial Sequence
  source: /note="Description of Artificial Sequence: Synthetic heavy chain variable region CDR H3"
ARTHIYDSSGYYLYYFDY

SEQ ID NO: 8 - DNA, 54 bp, Artificial Sequence
  source: /note="Description of Artificial Sequence: Synthetic heavy chain variable region CDR H3"
gcacggacccacatttatgatagtagtggttattatctatactactttgactac

SEQ ID NO: 9 - DNA, 321 bp, Artificial Sequence
  source: /note="Description of Artificial Sequence: Synthetic light chain variable region"
gatattgtgctgacccagtctccatcctccctgtctgcatctataggagacagagtcaccatcacttgccgggcaagtcagaccattgccagctatttaaattggtatcagcagaaaccagggaaagcccctgaactcctgatctatgctgcaaccaatttgcagagtggggtcccatcaaggttcagtggcagtggatctgggacagatttcactctcaccatcagcagtctgcgacctgaagattttgcaagttactactgtcaacagagttacagtagtccctggacgttcggccaagggaccaaagtggatatcaaa

SEQ ID NO: 10 - protein, 107 aa, Artificial Sequence
  source: /note="Description of Artificial Sequence: Synthetic light chain variable region"
DIVLTQSPSSLSASIGDRVTITCRASQTIASYLNWYQQKPGKAPELLIYAATNLQSGVPSRFSGSGSGTDFTLTISSLRPEDFASYYCQQSYSSPWTFGQGTKVDIK

SEQ ID NO: 11 - protein, 11 aa, Artificial Sequence
  source: /note="Description of Artificial Sequence: Synthetic light chain variable region CDR L1"
RASQTIASYLN

SEQ ID NO: 12 - DNA, 33 bp, Artificial Sequence
  source: /note="Description of Artificial Sequence: Synthetic light chain variable region CDR L1"
cgggcaagtcagaccattgccagctatttaaat

SEQ ID NO: 13 - protein, 7 aa, Artificial Sequence
  source: /note="Description of Artificial Sequence: Synthetic light chain variable region CDR L2"
AATNLQS

SEQ ID NO: 14 - DNA, 21 bp, Artificial Sequence
  source: /note="Description of Artificial Sequence: Synthetic light chain variable region CDR L2"
gctgcaaccaatttgcagagt

SEQ ID NO: 15 - protein, 9 aa, Artificial Sequence
  source: /note="Description of Artificial Sequence: Synthetic light chain variable region CDR L3"
QQSYSSPWT

SEQ ID NO: 16 - DNA, 27 bp, Artificial Sequence
  source: /note="Description of Artificial Sequence: Synthetic light chain variable region CDR L3"
caacagagttacagtagtccctggacg

SEQ ID NO: 17 - DNA, 372 bp, Artificial Sequence
  source: /note="Description of Artificial Sequence: Synthetic heavy chain variable region"
gaggtgcagctggtggagtctggcccaggactggtgaagccttcggggaccctgtccctcacctgcactgtctctggtgactccatgagtgattactactggagctggatccggcagtccccagggaggggactggagtggcttggatatatctattacgatgggagcaccaactacaacccctccctcaagggtcgaggcaccatttcaatagacacgtccaagagccagttctccctgacgctgagctctgtgaaggctgcggacacggccgtgtattactgtgcgagagggaagtactatgatagaggtggttattacctgttctaccttgactactggggccagggaatactggtcaccgtctcctca

SEQ ID NO: 18 - protein, 124 aa, Artificial Sequence
  source: /note="Description of Artificial Sequence: Synthetic heavy chain variable region"
EVQLVESGPGLVKPSGTLSLTCTVSGDSMSDYYWSWIRQSPGRGLEWLGYIYYDGSTNYNPSLKGRGTISIDTSKSQFSLTLSSVKAADTAVYYCARGKYYDRGGYYLFYLDYWGQGILVTVSS

SEQ ID NO: 19 - protein, 9 aa, Artificial Sequence
  source: /note="Description of Artificial Sequence: Synthetic heavy chain variable region CDR H1"
DSMSDYYWS

SEQ ID NO: 20 - DNA, 27 bp, Artificial Sequence
  source: /note="Description of Artificial Sequence: Synthetic heavy chain variable region CDR H1"
gactccatgagtgattactactggagc

SEQ ID NO: 21 - protein, 16 aa, Artificial Sequence
  source: /note="Description of Artificial Sequence: Synthetic heavy chain variable region CDR H2"
YIYYDGSTNYNPSLKG

SEQ ID NO: 22 - DNA, 48 bp, Artificial Sequence
  source: /note="Description of Artificial Sequence: Synthetic heavy chain variable region CDR H2"
tatatctattacgatgggagcaccaactacaacccctccctcaagggt

SEQ ID NO: 23 - protein, 18 aa, Artificial Sequence
  source: /note="Description of Artificial Sequence: Synthetic heavy chain variable region CDR H3"
ARGKYYDRGGYYLFYLDY

SEQ ID NO: 24 - DNA, 54 bp, Artificial Sequence
  source: /note="Description of Artificial Sequence: Synthetic heavy chain variable region CDR H3"
gcgagagggaagtactatgatagaggtggttattacctgttctaccttgactac

SEQ ID NO: 25 - DNA, 324 bp, Artificial Sequence
  source: /note="Description of Artificial Sequence: Synthetic light chain variable region"
gacatccggttgacccagtctccatcctccctgtctgcatctgtgggagacagagtcaccatcacttgccgggcaagtcagaccattgccagctatgtaaactggtatcagcagaaaccagggaaagcccctaaactccttatctatgctgcatccagtttgcaagatggggttccatcaaggttcagtggcagtggatctgggacagatttcgctctcaccatcagcagtctgcaacctgaagattttgcaatttacttttgtcaacagagttacagtacccccatattcactttcggccctgggaccaaggtggaaatcaaa

SEQ ID NO: 26 - protein, 108 aa, Artificial Sequence
  source: /note="Description of Artificial Sequence: Synthetic light chain variable region"
DIRLTQSPSSLSASVGDRVTITCRASQTIASYVNWYQQKPGKAPKLLIYAASSLQDGVPSRFSGSGSGTDFALTISSLQPEDFAIYFCQQSYSTPIFTFGPGTKVEIK

SEQ ID NO: 27 - protein, 11 aa, Artificial Sequence
  source: /note="Description of Artificial Sequence: Synthetic light chain variable region CDR L1"
RASQTIASYVN

SEQ ID NO: 28 - DNA, 33 bp, Artificial Sequence
  source: /note="Description of Artificial Sequence: Synthetic light chain variable region CDR L1"
cgggcaagtcagaccattgccagctatgtaaac

SEQ ID NO: 29 - protein, 7 aa, Artificial Sequence
  source: /note="Description of Artificial Sequence: Synthetic light chain variable region CDR L2"
AASSLQD

SEQ ID NO: 30 - DNA, 21 bp, Artificial Sequence
  source: /note="Description of Artificial Sequence: Synthetic light chain variable region CDR L2"
gctgcatccagtttgcaagat

SEQ ID NO: 31 - protein, 10 aa, Artificial Sequence
  source: /note="Description of Artificial Sequence: Synthetic light chain variable region CDR L3"
QQSYSTPIFT

SEQ ID NO: 32 - DNA, 30 bp, Artificial Sequence
  source: /note="Description of Artificial Sequence: Synthetic light chain variable region CDR L3"
caacagagttacagtacccccatattcact

SEQ ID NO: 33 - DNA, 369 bp, Artificial Sequence
  source: /note="Description of Artificial Sequence: Synthetic heavy chain variable region"
gaggtgcagctggtggagtctgggggcgccttggtaaagccgggggggtcccttagactctcctgtgtaggcactggactcactttcactactgcctacatgagctgggcccgccaggctccagggaaggggctggagtgggttggtcgtattaagagcaaaagtgatggtgggacaacagactaccctacacccgtcaaaggcagattcaccatctcaagagatgaatccaaaaacaccctgtatctgcaaatgaacagcctgaaaatcgaggacacagccgtctattattgtaccacagatagggggataacagctcgtcctatcttcgactcctggggccagggaaccctggtcaccgtctcctca

SEQ ID NO: 34 - protein, 123 aa, Artificial Sequence
  source: /note="Description of Artificial Sequence: Synthetic heavy chain variable region"
EVQLVESGGALVKPGGSLRLSCVGTGLTFTTAYMSWARQAPGKGLEWVGRIKSKSDGGTTDYPTPVKGRFTISRDESKNTLYLQMNSLKIEDTAVYYCTTDRGITARPIFDSWGQGTLVTVSS

SEQ ID NO: 35 - protein, 9 aa, Artificial Sequence
  source: /note="Description of Artificial Sequence: Synthetic heavy chain variable region CDR H1"
LTFTTAYMS

SEQ ID NO: 36 - DNA, 27 bp, Artificial Sequence
  source: /note="Description of Artificial Sequence: Synthetic heavy chain variable region CDR H1"
ctcactttcactactgcctacatgagc

SEQ ID NO: 37 - protein, 19 aa, Artificial Sequence
  source: /note="Description of Artificial Sequence: Synthetic heavy chain variable region CDR H2"
RIKSKSDGGTTDYPTPVKG

SEQ ID NO: 38 - DNA, 57 bp, Artificial Sequence
  source: /note="Description of Artificial Sequence: Synthetic heavy chain variable region CDR H2"
cgtattaagagcaaaagtgatggtgggacaacagactaccctacacccgtcaaaggc

SEQ ID NO: 39 - protein, 14 aa, Artificial Sequence
  source: /note="Description of Artificial Sequence: Synthetic heavy chain variable region CDR H3"
TTDRGITARPIFDS

SEQ ID NO: 40 - DNA, 42 bp, Artificial Sequence
  source: /note="Description of Artificial Sequence: Synthetic heavy chain variable region CDR H3"
accacagatagggggataacagctcgtcctatcttcgactcc

SEQ ID NO: 41 - DNA, 333 bp, Artificial Sequence
  source: /note="Description of Artificial Sequence: Synthetic light chain variable region"
cagtctgtcttgacgcagccgccctcagtgtctggggccctagggcggagggtcaccatctcctgcactgggagcagctccaacatcggggcgggttatgatgtacattggtacaggcaacttccaggaacagcccccaaactcctcatttatggtaacaccaaacggccctcaggggtccctgaccgattctctggctccaagtatgccacctcagcctccctggccatcactgggctccaggctgaggatgacgctgattattactgccagtcctatgacggcggcctgagtggttatgtcttcggaactgggaccaagctcaccgtccta

SEQ ID NO: 42 - protein, 111 aa, Artificial Sequence
  source: /note="Description of Artificial Sequence: Synthetic light chain variable region"
QSVLTQPPSVSGALGRRVTISCTGSSSNIGAGYDVHWYRQLPGTAPKLLIYGNTKRPSGVPDRFSGSKYATSASLAITGLQAEDDADYYCQSYDGGLSGYVFGTGTKLTVL

SEQ ID NO: 43 - protein, 14 aa, Artificial Sequence
  source: /note="Description of Artificial Sequence: Synthetic light chain variable region CDR L1"
TGSSSNIGAGYDVH

SEQ ID NO: 44 - DNA, 42 bp, Artificial Sequence
  source: /note="Description of Artificial Sequence: Synthetic light chain variable region CDR L1"
actgggagcagctccaacatcggggcgggttatgatgtacat

SEQ ID NO: 45 - protein, 7 aa, Artificial Sequence
  source: /note="Description of Artificial Sequence: Synthetic light chain variable region CDR L2"
GNTKRPS

SEQ ID NO: 46 - DNA, 21 bp, Artificial Sequence
  source: /note="Description of Artificial Sequence: Synthetic light chain variable region CDR L2"
ggtaacaccaaacggccctca

SEQ ID NO: 47 - protein, 11 aa, Artificial Sequence
  source: /note="Description of Artificial Sequence: Synthetic light chain variable region CDR L3"
QSYDGGLSGYV

SEQ ID NO: 48 - DNA, 33 bp, Artificial Sequence
  source: /note="Description of Artificial Sequence: Synthetic light chain variable region CDR L3"
cagtcctatgacggcggcctgagtggttatgtc

SEQ ID NO: 49 - DNA, 390 bp, Artificial Sequence
  source: /note="Description of Artificial Sequence: Synthetic heavy chain variable region"
caggtccagcttgtacagtctggggctgaggtgaagaagcctgggtcctcggtgaaggtctcctgcaaggcttctggaggcaacgtcaacatctatggaatcagttgggtgcgacaggcccctggacaagggcttgagtggatgggagggatcatccctatttatgatacaacaaagtacgcacagaaattccaggacagagtcacgattaccgcggacaaatccacgagtacagcctacatggagttgagcagcctgagatctgaggacacggccgtatatttctgtgcgagagatcttgattacgatattttgactggttattccgtaaactactactactacggtatggacgtctggggccaagggaccacggtcaccgtctcctca

SEQ ID NO: 50 - protein, 130 aa, Artificial Sequence
  source: /note="Description of Artificial Sequence: Synthetic heavy chain variable region"
QVQLVQSGAEVKKPGSSVKVSCKASGGNVNIYGISWVRQAPGQGLEWMGGIIPIYDTTKYAQKFQDRVTITADKSTSTAYMELSSLRSEDTAVYFCARDLDYDILTGYSVNYYYYGMDVWGQGTTVTVSS

SEQ ID NO: 51 - protein, 9 aa, Artificial Sequence
  source: /note="Description of Artificial Sequence: Synthetic heavy chain variable region CDR H1"
GNVNIYGIS

SEQ ID NO: 52 - DNA, 27 bp, Artificial Sequence
  source: /note="Description of Artificial Sequence: Synthetic heavy chain variable region CDR H1"
ggcaacgtcaacatctatggaatcagt

SEQ ID NO: 53 - protein, 17 aa, Artificial Sequence
  source: /note="Description of Artificial Sequence: Synthetic heavy chain variable region CDR H2"
GIIPIYDTTKYAQKFQD

SEQ ID NO: 54 - DNA, 51 bp, Artificial Sequence
  source: /note="Description of Artificial Sequence: Synthetic heavy chain variable region CDR H2"
gggatcatccctatttatgatacaacaaagtacgcacagaaattccaggac

SEQ ID NO: 55 - protein, 23 aa, Artificial Sequence
  source: /note="Description of Artificial Sequence: Synthetic heavy chain variable region CDR H3"
ARDLDYDILTGYSVNYYYYGMDV

SEQ ID NO: 56 - DNA, 69 bp, Artificial Sequence
  source: /note="Description of Artificial Sequence: Synthetic heavy chain variable region CDR H3"
gcgagagatcttgattacgatattttgactggttattccgtaaactactactactacggtatggacgtc

SEQ ID NO: 57 - DNA, 333 bp, Artificial Sequence
  source: /note="Description of Artificial Sequence: Synthetic light chain variable region"
cagtctgtcctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacatcaatcggccctcaggggtccctgaccgattctctggctccaagtctggcacctcagcctccctggccatcactgggctccaggctgaggatgaggctgattattactgccagtcctgtgacagcagcctaagtggttgggtgttcggcggagggaccaagctgaccatccta

SEQ ID NO: 58 - protein, 111 aa, Artificial Sequence
  source: /note="Description of Artificial Sequence: Synthetic light chain variable region"
QSVLTQPPSVSGAPGQRVTISCTGSSSNIGAGYDVHWYQQLPGTAPKLLIYGNINRPSGVPDRFSGSKSGTSASLAITGLQAEDEADYYCQSCDSSLSGWVFGGGTKLTIL

SEQ ID NO: 59 - protein, 14 aa, Artificial Sequence
  source: /note="Description of Artificial Sequence: Synthetic light chain variable region CDR L1"
TGSSSNIGAGYDVH

SEQ ID NO: 60 - DNA, 42 bp, Artificial Sequence
  source: /note="Description of Artificial Sequence: Synthetic light chain variable region CDR L1"
actgggagcagctccaacatcggggcaggttatgatgtacac

SEQ ID NO: 61 - protein, 7 aa, Artificial Sequence
  source: /note="Description of Artificial Sequence: Synthetic light chain variable region CDR L2"
GNINRPS

SEQ ID NO: 62 - DNA, 21 bp, Artificial Sequence
  source: /note="Description of Artificial Sequence: Synthetic light chain variable region CDR L2"
ggtaacatcaatcggccctca

SEQ ID NO: 63 - protein, 11 aa, Artificial Sequence
  source: /note="Description of Artificial Sequence: Synthetic light chain variable region CDR L3"
QSCDSSLSGWV

SEQ ID NO: 64 - DNA, 33 bp, Artificial Sequence
  source: /note="Description of Artificial Sequence: Synthetic light chain variable region CDR L3"
cagtcctgtgacagcagcctaagtggttgggtg

SEQ ID NO: 65 - DNA, 375 bp, Artificial Sequence
  source: /note="Description of Artificial Sequence: Synthetic heavy chain variable region"
caggtccagcttgtacagtctggggctgaagtgaagaggcctgggtcctcggtgaaggtctcctgcaaggcttctggaggcaccttcagcagctttgctatcaactgggtgcgacaggcccctggacaagggcttgagtggatgggagggctcatccctatctttggtacaccaaacaacgcacagaagttccagggcagagtcacgattaccgcggacgaatccacgagcacagcctacatggagctgagcagcctgagatctgaggacacggccgtctattactgtgcctcattacgatattttgactggcaacctggggggtcctactggttcgacccctggggccagggaaccctggtcaccgtctcctca

SEQ ID NO: 66 - protein, 125 aa, Artificial Sequence
  source: /note="Description of Artificial Sequence: Synthetic heavy chain variable region"
QVQLVQSGAEVKRPGSSVKVSCKASGGTFSSFAINWVRQAPGQGLEWMGGLIPIFGTPNNAQKFQGRVTITADESTSTAYMELSSLRSEDTAVYYCASLRYFDWQPGGSYWFDPWGQGTLVTVSS

SEQ ID NO: 67 - protein, 9 aa, Artificial Sequence
  source: /note="Description of Artificial Sequence: Synthetic heavy chain variable region CDR H1"
GTFSSFAIN

SEQ ID NO: 68 - DNA, 27 bp, Artificial Sequence
  source: /note="Description of Artificial Sequence: Synthetic heavy chain variable region CDR H1"
ggcaccttcagcagctttgctatcaac

SEQ ID NO: 69 - protein, 17 aa, Artificial Sequence
  source: /note="Description of Artificial Sequence: Synthetic heavy chain variable region CDR H2"
GLIPIFGTPNNAQKFQG

SEQ ID NO: 70 - DNA, 51 bp, Artificial Sequence
  source: /note="Description of Artificial Sequence: Synthetic heavy chain variable region CDR H2"
gggctcatccctatctttggtacaccaaacaacgcacagaagttccagggc

SEQ ID NO: 71 - protein, 18 aa, Artificial Sequence
  source: /note="Description of Artificial Sequence: Synthetic heavy chain variable region CDR H3"
ASLRYFDWQPGGSYWFDP

SEQ ID NO: 72 - DNA, 54 bp, Artificial Sequence
  source: /note="Description of Artificial Sequence: Synthetic heavy chain variable region CDR H3"
gcctcattacgatattttgactggcaacctggggggtcctactggttcgacccc

SEQ ID NO: 73 - DNA, 330 bp, Artificial Sequence
  source: /note="Description of Artificial Sequence: Synthetic light chain variable region"
cagcctgggctgactcagccaccctcagtgtcagtggccccaggaaagacggccaggattgcctgtgggggagacaacattggaactaaaggagtgcactggtaccagcagaagccaggccaggcccctgtgctggtcatctattatgatagcgaccggccctcagggatccctgagcgattctctggttccaactctgggaacacggccaccctgaccatcagcggggtcgaagccggggatgaggccgactactactgtcaggtttgggatactattgatgatcataaggatggactattcggcggagggaccaagctcaccgtccta

SEQ ID NO: 74 - protein, 110 aa, Artificial Sequence
  source: /note="Description of Artificial Sequence: Synthetic light chain variable region"
QPGLTQPPSVSVAPGKTARIACGGDNIGTKGVHWYQQKPGQAPVLVIYYDSDRPSGIPERFSGSNSGNTATLTISGVEAGDEADYYCQVWDTIDDHKDGLFGGGTKLTVL

SEQ ID NO: 75 - protein, 11 aa, Artificial Sequence
  source: /note="Description of Artificial Sequence: Synthetic light chain variable region CDR L1"
GGDNIGTKGVH

SEQ ID NO: 76 - DNA, 33 bp, Artificial Sequence
  source: /note="Description of Artificial Sequence: Synthetic light chain variable region CDR L1"
gggggagacaacattggaactaaaggagtgcac

SEQ ID NO: 77 - protein, 7 aa, Artificial Sequence
  source: /note="Description of Artificial Sequence: Synthetic light chain variable region CDR L2"
YDSDRPS

SEQ ID NO: 78 - DNA, 21 bp, Artificial Sequence
  source: /note="Description of Artificial Sequence: Synthetic light chain variable region CDR L2"
tatgatagcgaccggccctca

SEQ ID NO: 79 - protein, 13 aa, Artificial Sequence
  source: /note="Description of Artificial Sequence: Synthetic light chain variable region CDR L3"
QVWDTIDDHKDGL

SEQ ID NO: 80 - DNA, 39 bp, Artificial Sequence
  source: /note="Description of Artificial Sequence: Synthetic light chain variable region CDR L3"
caggtttgggatactattgatgatcataaggatggacta

SEQ ID NO: 81 - DNA, 375 bp, Artificial Sequence
  source: /note="Description of Artificial Sequence: Synthetic heavy chain variable region"
caggtccagcttgtgcagtctggaggtgaggtgaagaagcctggcgcctcagtgaaggtctcctgcaaggcttctggttacacctttaccacctatggaatcagctgggtgcgacaggcccctggacatgggcttgagtggctgggatggatcagccctaagaatggcaacacaaagtatgcacagaaggtccagggcagagtcaccatgaccatagacccaaccacgagtacagcctacatggaactgaggagcctgagatcagacgacacggccatgtattactgtgcgagagactatattgtagcaatagtggctgctctcccccacggtatggacgtctggggccaagggaccctggtcactgtctcctca

SEQ ID NO: 82 - protein, 125 aa, Artificial Sequence
  source: /note="Description of Artificial Sequence: Synthetic heavy chain variable region"
QVQLVQSGGEVKKPGASVKVSCKASGYTFTTYGISWVRQAPGHGLEWLGWISPKNGNTKYAQKVQGRVTMTIDPTTSTAYMELRSLRSDDTAMYYCARDYIVAIVAALPHGMDVWGQGTLVTVSS

SEQ ID NO: 83 - protein, 9 aa, Artificial Sequence
  source: /note="Description of Artificial Sequence: Synthetic heavy chain variable region CDR H1"
YTFTTYGIS

SEQ ID NO: 84 - DNA, 27 bp, Artificial Sequence
  source: /note="Description of Artificial Sequence: Synthetic heavy chain variable region CDR H1"
tacacctttaccacctatggaatcagc

SEQ ID NO: 85 - protein, 17 aa, Artificial Sequence
  source: /note="Description of Artificial Sequence: Synthetic heavy chain variable region CDR H2"
WISPKNGNTKYAQKVQG

SEQ ID NO: 86 - DNA, 51 bp, Artificial Sequence
  source: /note="Description of Artificial Sequence: Synthetic heavy chain variable region CDR H2"
tggatcagccctaagaatggcaacacaaagtatgcacagaaggtccagggc

SEQ ID NO: 87 - protein, 18 aa, Artificial Sequence
  source: /note="Description of Artificial Sequence: Synthetic heavy chain variable region CDR H3"
ARDYIVAIVAALPHGMDV

SEQ ID NO: 88 - DNA, 54 bp, Artificial Sequence
  source: /note="Description of Artificial Sequence: Synthetic heavy chain variable region CDR H3"
gcgagagactatattgtagcaatagtggctgctctcccccacggtatggacgtc

SEQ ID NO: 89 - DNA, 318 bp, Artificial Sequence
  source: /note="Description of Artificial Sequence: Synthetic light chain variable region"
cagtctgtcttgacgcagccgccctccctgtccgtgtccccaggacagacagccagcatctcctgctctggggatcagttggggaataaatatgtttgttggtatcagcagaagccaggccagtcccctgttctggtcatctatcaagattccaggcggccctcaggggtccctgagcgattctctggctccaactccgggaacacagccactctgaccgtcggcgggacccagcctatggatgaggctgactattactgtcaggcgtgggacagcagcattcgggtattcggcggagggaccaaggtgaccgtccta

SEQ ID NO: 90 - protein, 106 aa, Artificial Sequence
  source: /note="Description of Artificial Sequence: Synthetic light chain variable region"
QSVLTQPPSLSVSPGQTASISCSGDQLGNKYVCWYQQKPGQSPVLVIYQDSRRPSGVPERFSGSNSGNTATLTVGGTQPMDEADYYCQAWDSSIRVFGGGTKVTVL

SEQ ID NO: 91 - protein, 11 aa, Artificial Sequence
  source: /note="Description of Artificial Sequence: Synthetic light chain variable region CDR L1"
SGDQLGNKYVC

SEQ ID NO: 92 - DNA, 33 bp, Artificial Sequence
  source: /note="Description of Artificial Sequence: Synthetic light chain variable region CDR L1"
tctggggatcagttggggaataaatatgtttgt

SEQ ID NO: 93 - protein, 7 aa, Artificial Sequence
  source: /note="Description of Artificial Sequence: Synthetic light chain variable region CDR L2"
QDSRRPS

SEQ ID NO: 94 - DNA, 21 bp, Artificial Sequence
  source: /note="Description of Artificial Sequence: Synthetic light chain variable region CDR L2"
caagattccaggcggccctca

SEQ ID NO: 95 - protein, 9 aa, Artificial Sequence
  source: /note="Description of Artificial Sequence: Synthetic light chain variable region CDR L3"
QAWDSSIRV

SEQ ID NO: 96 - DNA, 27 bp, Artificial Sequence
  source: /note="Description of Artificial Sequence: Synthetic light chain variable region CDR L3"
caggcgtgggacagcagcattcgggta

SEQ ID NO: 97 - DNA, 375 bp, Artificial Sequence
  source: /note="Description of Artificial Sequence: Synthetic heavy chain variable region"
caggtccagcttgtacagtctggggctgaggtgaagaagcctgggtcctcggtgaaggtctcctgcaaggcctctggaggctccttgagcacctatgggatccactgggtgcgacaggcccctggccaaggccttgagtgggtgggaggggtcatgactgtctatggcaaaacaacctacggacagaacttccagggcagagtcaccattgccgtggacagatcgaccaacacagcctacatggaactgagcagcctaacatctgacgacacgggtacttattactgtgcgacagactcctactatgtttggactggttcttatccccccccctttgacctctggggccagggaaccctggtcaccgtctcctca

SEQ ID NO: 98 - protein, 125 aa, Artificial Sequence
  source: /note="Description of Artificial Sequence: Synthetic heavy chain variable region"
QVQLVQSGAEVKKPGSSVKVSCKASGGSLSTYGIHWVRQAPGQGLEWVGGVMTVYGKTTYGQNFQGRVTIAVDRSTNTAYMELSSLTSDDTGTYYCATDSYYVWTGSYPPPFDLWGQGTLVTVSS

SEQ ID NO: 99 - protein, 9 aa, Artificial Sequence
  source: /note="Description of Artificial Sequence: Synthetic heavy chain variable region CDR H1"
GSLSTYGIH

SEQ ID NO: 100 - DNA, 27 bp, Artificial Sequence
  source: /note="Description of Artificial Sequence: Synthetic heavy chain variable region CDR H1"
ggctccttgagcacctatgggatccac

SEQ ID NO: 101 - protein, 17 aa, Artificial Sequence
  source: /note="Description of Artificial Sequence: Synthetic heavy chain variable region CDR H2"
GVMTVYGKTTYGQNFQG

SEQ ID NO: 102 - DNA, 51 bp, Artificial Sequence
  source: /note="Description of Artificial Sequence: Synthetic heavy chain variable region CDR H2"
ggggtcatgactgtctatggcaaaacaacctacggacagaacttccagggc

SEQ ID NO: 103 - protein, 18 aa, Artificial Sequence
  source: /note="Description of Artificial Sequence: Synthetic heavy chain variable region CDR H3"
ATDSYYVWTGSYPPPFDL

SEQ ID NO: 104 - DNA, 54 bp, Artificial Sequence
  source: /note="Description of Artificial Sequence: Synthetic heavy chain variable region CDR H3"
gcgacagactcctactatgtttggactggttcttatccccccccctttgacctc

SEQ ID NO: 105 - DNA, 324 bp, Artificial Sequence
  source: /note="Description of Artificial Sequence: Synthetic light chain variable region"
gaaattgtgttgacccagactccaggcacccagtctttgtctccagggcaaagtgccaccctctcctgcagggccagtcacagtgtcggcaacgactacttggcctggtatcagcagaagcctggccagtctccccggctcctcattcacggtgcatacaggagggactctggcatcccagacaggttcattggcagtgggtctgggacagacttcactctcaccatcgacagtctggagcctgacgattgtgcagtatattactgtcagcagtatgggagctggcctctcactttcggcggagggaccaaagtggatatcaaa

SEQ ID NO: 106 - protein, 108 aa, Artificial Sequence
  source: /note="Description of Artificial Sequence: Synthetic light chain variable region"
EIVLTQTPGTQSLSPGQSATLSCRASHSVGNDYLAWYQQKPGQSPRLLIHGAYRRDSGIPDRFIGSGSGTDFTLTIDSLEPDDCAVYYCQQYGSWPLTFGGGTKVDIK

SEQ ID NO: 107 - protein, 12 aa, Artificial Sequence
  source: /note="Description of Artificial Sequence: Synthetic light chain variable region CDR L1"
RASHSVGNDYLA

SEQ ID NO: 108 - DNA, 36 bp, Artificial Sequence
  source: /note="Description of Artificial Sequence: Synthetic light chain variable region CDR L1"
agggccagtcacagtgtcggcaacgactacttggcc

SEQ ID NO: 109 - protein, 7 aa, Artificial Sequence
  source: /note="Description of Artificial Sequence: Synthetic light chain variable region CDR L2"
GAYRRDS

SEQ ID NO: 110 - DNA, 21 bp, Artificial Sequence
  source: /note="Description of Artificial Sequence: Synthetic light chain variable region CDR L2"
ggtgcatacaggagggactct

SEQ ID NO: 111 - protein, 9 aa, Artificial Sequence
  source: /note="Description of Artificial Sequence: Synthetic light chain variable region CDR L3"
QQYGSWPLT

SEQ ID NO: 112 - DNA, 27 bp, Artificial Sequence
  source: /note="Description of Artificial Sequence: Synthetic light chain variable region CDR L3"
cagcagtatgggagctggcctctcact

SEQ ID NO: 113 - DNA, 366 bp, Artificial Sequence
  source: /note="Description of Artificial Sequence: Synthetic heavy chain variable region"
gaggtgcagctggtggagtctgggggaggcgtggtccagcctgggaggtccctgagactctcctgtgttacctctggattcatcttcagcaattatgctatgcactgggtccgccaggctccaggcaaggggctggagtgggtggcagttatatcctttgatgcagacaatgaatattatgcagagtccgtgaagggccgattcaccatctccagagacaattccaagaacacgatgtatctgcaaatgaacagcctgagagccggggacacagctctctattactgtgcgagagatcctctgggtataggagtgaagggctacgttgacttctggggccagggaaccctggtcaccgtctcctca

SEQ ID NO: 114 - protein, 122 aa, Artificial Sequence
  source: /note="Description of Artificial Sequence: Synthetic heavy chain variable region"
EVQLVESGGGVVQPGRSLRLSCVTSGFIFSNYAMHWVRQAPGKGLEWVAVISFDADNEYYAESVKGRFTISRDNSKNTMYLQMNSLRAGDTALYYCARDPLGIGVKGYVDFWGQGTLVTVSS

SEQ ID NO: 115 - protein, 9 aa, Artificial Sequence
  source: /note="Description of Artificial Sequence: Synthetic heavy chain variable region CDR H1"
FIFSNYAMH

SEQ ID NO: 116 - DNA, 27 bp, Artificial Sequence
  source: /note="Description of Artificial Sequence: Synthetic heavy chain variable region CDR H1"
ttcatcttcagcaattatgctatgcac

SEQ ID NO: 117 - protein, 17 aa, Artificial Sequence
  source: /note="Description of Artificial Sequence: Synthetic heavy chain variable region CDR H2"
VISFDADNEYYAESVKG

SEQ ID NO: 118 - DNA, 51 bp, Artificial Sequence
  source: /note="Description of Artificial Sequence: Synthetic heavy chain variable region CDR H2"
gttatatcctttgatgcagacaatgaatattatgcagagtccgtgaagggc

SEQ ID NO: 119 - protein, 15 aa, Artificial Sequence
  source: /note="Description of Artificial Sequence: Synthetic heavy chain variable region CDR H3"
ARDPLGIGVKGYVDF

SEQ ID NO: 120 - DNA, 45 bp, Artificial Sequence
  source: /note="Description of Artificial Sequence: Synthetic heavy chain variable region CDR H3"
gcgagagatcctctgggtataggagtgaagggctacgttgacttc

SEQ ID NO: 121 - DNA, 324 bp, Artificial Sequence
  source: /note="Description of Artificial Sequence: Synthetic light chain variable region"
tcctctgagctgagtcagccaccctcagtgtcagtggccccaggagagacggccaggattacttgtgggggagacaactttggaagtgacggtctgcactggtaccagcagaagccaggccaggcccctgtgttggtcatctattatgatagcgaccggccctcagggatccctgagcgattctccggctccatctctgggaacacggccaccttgaccatcagcagggtcgaagccggggatgaggccgactatttctgtcaggtgtgggatagtattagtgatcatctggtattcggcggggggaccaaggtgaccgtccta

SEQ ID NO: 122 - protein, 108 aa, Artificial Sequence
  source: /note="Description of Artificial Sequence: Synthetic light chain variable region"
SSELSQPPSVSVAPGETARITCGGDNFGSDGLHWYQQKPGQAPVLVIYYDSDRPSGIPERFSGSISGNTATLTISRVEAGDEADYFCQVWDSISDHLVFGGGTKVTVL

SEQ ID NO: 123 - protein, 11 aa, Artificial Sequence
  source: /note="Description of Artificial Sequence: Synthetic light chain variable region CDR L1"
GGDNFGSDGLH

SEQ ID NO: 124 - DNA, 33 bp, Artificial Sequence
  source: /note="Description of Artificial Sequence: Synthetic light chain variable region CDR L1"
gggggagacaactttggaagtgacggtctgcac

SEQ ID NO: 125 - protein, 7 aa, Artificial Sequence
  source: /note="Description of Artificial Sequence: Synthetic light chain variable region CDR L2"
YDSDRPS

SEQ ID NO: 126 - DNA, 21 bp, Artificial Sequence
  source: /note="Description of Artificial Sequence: Synthetic light chain variable region CDR L2"
tatgatagcgaccggccctca

SEQ ID NO: 127 - protein, 11 aa, Artificial Sequence
  source: /note="Description of Artificial Sequence: Synthetic light chain variable region CDR L3"
QVWDSISDHLV

SEQ ID NO: 128 - DNA, 33 bp, Artificial Sequence
  source: /note="Description of Artificial Sequence: Synthetic light chain variable region CDR L3"
caggtgtgggatagtattagtgatcatctggta

SEQ ID NO: 129 - DNA, 372 bp, Artificial Sequence
  source: /note="Description of Artificial Sequence: Synthetic heavy chain variable region"
caggtccagcttgtgcagtctggggctgaggtgaagaagcctgggtcctcggtgaaggtctcctgcaaggcttctggaggcaccttcagcagttatgctatcaactgggtgcgacaggcccctggacaagggcttgagtggatgggagggatcatccctgcctttggtacaacaatctacgcacagaggttccaggacagagtcacgattaccgcggacaaatccacgagcacagcctacatggagctgaggagcctgagatctgaggacacggccgtgtattactgtgcgaggtcaccacccttttggagtgactatagccgtgggtggttcgacccctggggccagggaaccctggtcaccgtctcctca

SEQ ID NO: 130 - protein, 124 aa, Artificial Sequence
  source: /note="Description of Artificial Sequence: Synthetic heavy chain variable region"
QVQLVQSGAEVKKPGSSVKVSCKASGGTFSSYAINWVRQAPGQGLEWMGGIIPAFGTTIYAQRFQDRVTITADKSTSTAYMELRSLRSEDTAVYYCARSPPFWSDYSRGWFDPWGQGTLVTVSS

SEQ ID NO: 131 - protein, 9 aa, Artificial Sequence
  source: /note="Description of Artificial Sequence: Synthetic heavy chain variable region CDR H1"
GTFSSYAIN

SEQ ID NO: 132 - DNA, 27 bp, Artificial Sequence
  source: /note="Description of Artificial Sequence: Synthetic heavy chain variable region CDR H1"
ggcaccttcagcagttatgctatcaac

SEQ ID NO: 133 - protein, 17 aa, Artificial Sequence
  source: /note="Description of Artificial Sequence: Synthetic heavy chain variable region CDR H2"
GIIPAFGTTIYAQRFQD

SEQ ID NO: 134 - DNA, 51 bp, Artificial Sequence
  source: /note="Description of Artificial Sequence: Synthetic heavy chain variable region CDR H2"
gggatcatccctgcctttggtacaacaatctacgcacagaggttccaggac

SEQ ID NO: 135 - protein, 17 aa, Artificial Sequence
  source: /note="Description of Artificial Sequence: Synthetic heavy chain variable region CDR H3"
ARSPPFWSDYSRGWFDP

SEQ ID NO: 136 - DNA, 51 bp, Artificial Sequence
  source: /note="Description of Artificial Sequence: Synthetic heavy chain variable region CDR H3"
gcgaggtcaccacccttttggagtgactatagccgtgggtggttcgacccc

SEQ ID NO: 137 - DNA, 321 bp, Artificial Sequence
  source: /note="Description of Artificial Sequence: Synthetic light chain variable region"
gaaacgacactcacgcagtctccatccgccctgtctgcatctgtaggagacagagtcaccatcacttgccgggcaagtcagaccattagcggctatttaaattggtatcagcagaaaccagggaaagcccctaagctcctgatctatgctgcatccagtttgcaaagtggggtcccgtcgagattcagtggcagtagcgctgggacagatttcactctctccatcagcaatctacaacctgaagattttgcaacttactactgtcaacagagttacactaccccgtggacgttcggccaagggaccaaggtggaaatcaaa

SEQ ID NO: 138 - protein, 107 aa, Artificial Sequence
  source: /note="Description of Artificial Sequence: Synthetic light chain variable region"
ETTLTQSPSALSASVGDRVTITCRASQTISGYLNWYQQKPGKAPKLLIYAASSLQSGVPSRFSGSSAGTDFTLSISNLQPEDFATYYCQQSYTTPWTFGQGTKVEIK

SEQ ID NO: 139 - protein, 11 aa, Artificial Sequence
  source: /note="Description of Artificial Sequence: Synthetic light chain variable region CDR L1"
RASQTISGYLN

SEQ ID NO: 140 - DNA, 33 bp, Artificial Sequence
  source: /note="Description of Artificial Sequence: Synthetic light chain variable region CDR L1"
cgggcaagtcagaccattagcggctatttaaat

SEQ ID NO: 141 - protein, 7 aa, Artificial Sequence
  source: /note="Description of Artificial Sequence: Synthetic light chain variable region CDR L2"
AASSLQS

SEQ ID NO: 142 - DNA, 21 bp, Artificial Sequence
  source: /note="Description of Artificial Sequence: Synthetic light chain variable region CDR L2"
gctgcatccagtttgcaaagt

SEQ ID NO: 143 - protein, 9 aa, Artificial Sequence
  source: /note="Description of Artificial Sequence: Synthetic light chain variable region CDR L3"
QQSYTTPWT

SEQ ID NO: 144 - DNA, 27 bp, Artificial Sequence
  source: /note="Description of Artificial Sequence: Synthetic light chain variable region CDR L3"
caacagagttacactaccccgtggacg

SEQ ID NO: 145 - DNA, 354 bp, Artificial Sequence
  source: /note="Description of Artificial Sequence: Synthetic heavy chain variable region"
caggtccagctggtgcagtctggagcagaggtgaaaaagcccggagactctctgaagatctcctgtaagaatgctggacacacctctagaatctactggatcgcctgggtgcgccagatgcccgcgaaaggcctggagtacatgggcatcatctttcctggtgactctgataccagatacagtccgtccttccgaggccaggtcaccatctcagccgacaggtccatcagaactgcctacctgcagttgagcagcctgaaggcctcggacaccggcatttattactgtgcgacacaggggcttgagggggcttttgactactggggccagggaaccctggtcaccgtctcctca

SEQ ID NO: 146 - protein, 118 aa, Artificial Sequence
  source: /note="Description of Artificial Sequence: Synthetic heavy chain variable region"
QVQLVQSGAEVKKPGDSLKISCKNAGHTSRIYWIAWVRQMPAKGLEYMGIIFPGDSDTRYSPSFRGQVTISADRSIRTAYLQLSSLKASDTGIYYCATQGLEGAFDYWGQGTLVTVSS

SEQ ID NO: 147 - protein, 9 aa, Artificial Sequence
  source: /note="Description of Artificial Sequence: Synthetic heavy chain variable region CDR H1"
HTSRIYWIA

SEQ ID NO: 148 - DNA, 27 bp, Artificial Sequence
  source: /note="Description of Artificial Sequence: Synthetic heavy chain variable region CDR H1"
cacacctctagaatctactggatcgcc

SEQ ID NO: 149 - protein, 17 aa, Artificial Sequence
  source: /note="Description of Artificial Sequence: Synthetic heavy chain variable region CDR H2"
IIFPGDSDTRYSPSFRG

SEQ ID NO: 150 - DNA, 51 bp, Artificial Sequence
  source: /note="Description of Artificial Sequence: Synthetic heavy chain variable region CDR H2"
atcatctttcctggtgactctgataccagatacagtccgtccttccgaggc

SEQ ID NO: 151 - protein, 11 aa, Artificial Sequence
  source: /note="Description of Artificial Sequence: Synthetic heavy chain variable region CDR H3"
ATQGLEGAFDY

SEQ ID NO: 152 - DNA, 33 bp, Artificial Sequence
  source: /note="Description of Artificial Sequence: Synthetic heavy chain variable region CDR H3"
gcgacacaggggcttgagggggcttttgactac

SEQ ID NO: 153 - DNA, 324 bp, Artificial Sequence
  source: /note="Description of Artificial Sequence: Synthetic light chain variable region"
gacatccggttgacccagtctccatcctccctgtctgcatctgtaggagacagagtcaccatcacttgccaggcgagtcaggacattagcaaccagttaaattggtatcagcagaaaccagggacagcccctaagctcctcatctacgatgcatcctttttgcaaacaggggtcccatcaaggttcagtggaagtggatctgggacacattttactttcaccatcaccagcctgcagcctgaagattttgcaacatatttctgtcagcattatgatagtttccccatattcactttcggccctgggaccaagctggagatcaaa

SEQ ID NO: 154 - protein, 108 aa, Artificial Sequence
  source: /note="Description of Artificial Sequence: Synthetic light chain variable region"
DIRLTQSPSSLSASVGDRVTITCQASQDISNQLNWYQQKPGTAPKLLIYDASFLQTGVPSRFSGSGSGTHFTFTITSLQPEDFATYFCQHYDSFPIFTFGPGTKLEIK

SEQ ID NO: 155 - protein, 11 aa, Artificial Sequence
  source: /note="Description of Artificial Sequence: Synthetic light chain variable region CDR L1"
QASQDISNQLN

SEQ ID NO: 156 - DNA, 33 bp, Artificial Sequence
  source: /note="Description of Artificial Sequence: Synthetic light chain variable region CDR L1"
caggcgagtcaggacattagcaaccagttaaat

SEQ ID NO: 157 - protein, 7 aa, Artificial Sequence
  source: /note="Description of Artificial Sequence: Synthetic light chain variable region CDR L2"
DASFLQT

SEQ ID NO: 158 - DNA, 21 bp, Artificial Sequence
  source: /note="Description of Artificial Sequence: Synthetic light chain variable region CDR L2"
gatgcatcctttttgcaaaca

SEQ ID NO: 159 - protein, 10 aa, Artificial Sequence
  source: /note="Description of Artificial Sequence: Synthetic light chain variable region CDR L3"
QHYDSFPIFT

SEQ ID NO: 160 - DNA, 30 bp, Artificial Sequence
  source: /note="Description of Artificial Sequence: Synthetic light chain variable region CDR L3"
cagcattatgatagtttccccatattcact

SEQ ID NO: 161 - DNA, 378 bp, Artificial Sequence
  source: /note="Description of Artificial Sequence: Synthetic heavy chain variable region"
gaggtgcagctggtggagtctgggggaggcttggtacagcctggcaggtccctgcgactctcctgtgcagcctctggattcacctttgatgattatgccatgcactgggtccggcaagctccagggaagggcctggagtgggtctcaggcatcagttggaatagtggtattgtaaagtatgcggactctgtgaagggccgattcaccatctccagagacaacgccaagaactccctgtatctgcaaatgaacagtctgagaactgaggacacggccttgtattattgtgtaaaagacggttataccagcagttggcactcggactaccactacggcttggacgtctggggccaagggaccacggtcaccgtctcctca

SEQ ID NO: 162 - protein, 126 aa, Artificial Sequence
  source: /note="Description of Artificial Sequence: Synthetic heavy chain variable region"
EVQLVESGGGLVQPGRSLRLSCAASGFTFDDYAMHWVRQAPGKGLEWVSGISWNSGIVKYADSVKGRFTISRDNAKNSLYLQMNSLRTEDTALYYCVKDGYTSSWHSDYHYGLDVWGQGTTVTVSS

SEQ ID NO: 163 - protein, 9 aa, Artificial Sequence
  source: /note="Description of Artificial Sequence: Synthetic heavy chain variable region CDR H1"
FTFDDYAMH

SEQ ID NO: 164 - DNA, 27 bp, Artificial Sequence
  source: /note="Description of Artificial Sequence: Synthetic heavy chain variable region CDR H1"
ttcacctttgatgattatgccatgcac

SEQ ID NO: 165 - protein, 17 aa, Artificial Sequence
  source: /note="Description of Artificial Sequence: Synthetic heavy chain variable region CDR H2"
GISWNSGIVKYADSVKG

SEQ ID NO: 166 - DNA, 51 bp, Artificial Sequence
  source: /note="Description of Artificial Sequence: Synthetic heavy chain variable region CDR H2"
ggcatcagttggaatagtggtattgtaaagtatgcggactctgtgaagggc

SEQ ID NO: 167 - protein, 19 aa, Artificial Sequence
  source: /note="Description of Artificial Sequence: Synthetic heavy chain variable region CDR H3"
VKDGYTSSWHSDYHYGLDV

SEQ ID NO: 168 - DNA, 57 bp, Artificial Sequence
  source: /note="Description of Artificial Sequence: Synthetic heavy chain variable region CDR H3"
gtaaaagacggttataccagcagttggcactcggactaccactacggcttggacgtc

SEQ ID NO: 169 - DNA, 321 bp, Artificial Sequence
  source: /note="Description of Artificial Sequence: Synthetic light chain variable region"
gatattgtgatgactcagtctccagccaccctgtctctgtctccaggggacagagccaccctctcctgcagggccagtcagaatgttatcagcaacttggcctggtaccagcagaaacctggccaggctcccaggctcctcatctatactgtatccaccagggccactggtatcccagccaggttcagtggcagtgggtctgggacagacttcactctcaccatcagcagcctgcagtctgaagattttgcagtttattactgtcagcagtataataactggcctctcactttcggcggagggaccaaggtggaaatcaaa

SEQ ID NO: 170 - protein, 107 aa, Artificial Sequence
  source: /note="Description of Artificial Sequence: Synthetic light chain variable region"
DIVMTQSPATLSLSPGDRATLSCRASQNVISNLAWYQQKPGQAPRLLIYTVSTRATGIPARFSGSGSGTDFTLTISSLQSEDFAVYYCQQYNNWPLTFGGGTKVEIK

SEQ ID NO: 171 - protein, 11 aa, Artificial Sequence
  source: /note="Description of Artificial Sequence: Synthetic light chain variable region CDR L1"
RASQNVISNLA

SEQ ID NO: 172 - DNA, 33 bp, Artificial Sequence
  source: /note="Description of Artificial Sequence: Synthetic light chain variable region CDR L1"
agggccagtcagaatgttatcagcaacttggcc

SEQ ID NO: 173 - protein, 7 aa, Artificial Sequence
  source: /note="Description of Artificial Sequence: Synthetic light chain variable region CDR L2"
TVSTRAT

SEQ ID NO: 174 - DNA, 21 bp, Artificial Sequence
  source: /note="Description of Artificial Sequence: Synthetic light chain variable region CDR L2"
actgtatccaccagggccact

SEQ ID NO: 175 - protein, 9 aa, Artificial Sequence
  source: /note="Description of Artificial Sequence: Synthetic light chain variable region CDR L3"
QQYNNWPLT

SEQ ID NO: 176 - DNA, 27 bp, Artificial Sequence
  source: /note="Description of Artificial Sequence: Synthetic light chain variable region CDR L3"
cagcagtataataactggcctctcact

SEQ ID NO: 177 - DNA, 372 bp, Artificial Sequence
  source: /note="Description of Artificial Sequence: Synthetic heavy chain variable region"
caggtccagcttgtgcagtctggggctgaggtgaagaagcctgggtcgtcggtgaaggtctcctgcaaggcttctggagacaccttcaacagttattccatcagctgggtgcgacaggcccctggacaagggcttgagtggatgggaggaatcctccctatgtttggttcgtcagactacgcacagaagttccagggcagactcacaattaccgcggacgaatccacgaggacagcctacatggagctgaacagtctgacatctgaggacacggccatttactactgtgcgagagacaattactatgtttggactggtcgttatcccgaatttgacttctggggccagggaaccctggtcaccgtctcctca

SEQ ID NO: 178 - protein, 124 aa, Artificial Sequence
  source: /note="Description of Artificial Sequence: Synthetic heavy chain variable region"
QVQLVQSGAEVKKPGSSVKVSCKASGDTFNSYSISWVRQAPGQGLEWMGGILPMFGSSDYAQKFQGRLTITADESTRTAYMELNSLTSEDTAIYYCARDNYYVWTGRYPEFDFWGQGTLVTVSS

SEQ ID NO: 179 - protein, 9 aa, Artificial Sequence
  source: /note="Description of Artificial Sequence: Synthetic heavy chain variable region CDR H1"
DTFNSYSIS

SEQ ID NO: 180 - DNA, 27 bp, Artificial Sequence
  source: /note="Description of Artificial Sequence: Synthetic heavy chain variable region CDR H1"
gacaccttcaacagttattccatcagc

SEQ ID NO: 181 - protein, 17 aa, Artificial Sequence
  source: /note="Description of Artificial Sequence: Synthetic heavy chain variable region CDR H2"
GILPMFGSSDYAQKFQG

SEQ ID NO: 182 - DNA, 51 bp, Artificial Sequence
  source: /note="Description of Artificial Sequence: Synthetic heavy chain variable region CDR H2"
ggaatcctccctatgtttggttcgtcagactacgcacagaagttccagggc

SEQ ID NO: 183 - protein, 17 aa, Artificial Sequence
  source: /note="Description of Artificial Sequence: Synthetic heavy chain variable region CDR H3"
ARDNYYVWTGRYPEFDF

SEQ ID NO: 184 - DNA, 51 bp, Artificial Sequence
  source: /note="Description of Artificial Sequence: Synthetic heavy chain variable region CDR H3"
gcgagagacaattactatgtttggactggtcgttatcccgaatttgacttc

SEQ ID NO: 185 - DNA, 324 bp, Artificial Sequence
  source: /note="Description of Artificial Sequence: Synthetic light chain variable region"
gaaattgtgttgacacagtctccaggcaccctgtccttgtctccaggggatgaagccaccctctcctgcagggccagtcagagtgttaccagcaattacttagcctggtaccagcagaggcctggccaggctcccaggctcctcatctctggtgcatccagaagggccactgccgtcccagacaggttcagtggcagtgggtctgggacagacttcactctcaccatcagcagactggagcctgaagattttgcagtttattactgtcagcaatatggaagcacaccgatcaccttcggccaggggacacgactggagattaaa

SEQ ID NO: 186 - protein, 108 aa, Artificial Sequence
  source: /note="Description of Artificial Sequence: Synthetic light chain variable region"
EIVLTQSPGTLSLSPGDEATLSCRASQSVTSNYLAWYQQRPGQAPRLLISGASRRATAVPDRFSGSGSGTDFTLTISRLEPEDFAVYYCQQYGSTPITFGQGTRLEIK

SEQ ID NO: 187 - protein, 12 aa, Artificial Sequence
  source: /note="Description of Artificial Sequence: Synthetic light chain variable region CDR L1"
RASQSVTSNYLA

SEQ ID NO: 188 - DNA, 36 bp, Artificial Sequence
  source: /note="Description of Artificial Sequence: Synthetic light chain variable region CDR L1"
agggccagtcagagtgttaccagcaattacttagcc

SEQ ID NO: 189 - protein, 7 aa, Artificial Sequence
  source: /note="Description of Artificial Sequence: Synthetic light chain variable region CDR L2"
GASRRAT

SEQ ID NO: 190 - DNA, 21 bp, Artificial Sequence
  source: /note="Description of Artificial Sequence: Synthetic light chain variable region CDR L2"
ggtgcatccagaagggccact

SEQ ID NO: 191 - protein, 9 aa, Artificial Sequence
  source: /note="Description of Artificial Sequence: Synthetic light chain variable region CDR L3"
QQYGSTPIT

SEQ ID NO: 192 - DNA, 27 bp, Artificial Sequence
  source: /note="Description of Artificial Sequence: Synthetic light chain variable region CDR L3"
cagcaatatggaagcacaccgatcacc

SEQ ID NO: 193 - DNA, 351 bp, Artificial Sequence
  source: /note="Description of Artificial Sequence: Synthetic heavy chain variable region"
caggtccagctggtgcagtctggagctgaggtgaagaagcctggggcctcagtgaaggtctcctgcaaggcttctggatacactttcaccaatgatataaactgggtgcgacaggccactggacaagggcttgagtggatggggtggatgaaccctaacaatggtcacacaggctatgcacagagcttcgagggcagagtcagcatgaccaggaactccgccataaacacagcctacctggagctgagcagcctgagatttgacgatacggccatatattattgtgtatacaatttctggagtgattcttcagtctcctggggccagggaaccctggtcaccgtctcctca

SEQ ID NO: 194 - protein, 117 aa, Artificial Sequence
  source: /note="Description of Artificial Sequence: Synthetic heavy chain variable region"
QVQLVQSGAEVKKPGASVKVSCKASGYTFTNDINWVRQATGQGLEWMGWMNPNNGHTGYAQSFEGRVSMTRNSAINTAYLELSSLRFDDTAIYYCVYNFWSDSSVSWGQGTLVTVSS

SEQ ID NO: 195 - protein, 8 aa, Artificial Sequence
  source: /note="Description of Artificial Sequence: Synthetic heavy chain variable region CDR H1"
YTFTNDIN

SEQ ID NO: 196 - DNA, 24 bp, Artificial Sequence
  source: /note="Description of Artificial Sequence: Synthetic heavy chain variable region CDR H1"
tacactttcaccaatgatataaac

SEQ ID NO: 197 - protein, 17 aa, Artificial Sequence
  source: /note="Description of Artificial Sequence: Synthetic heavy chain variable region CDR H2"
WMNPNNGHTGYAQSFEG

SEQ ID NO: 198 - DNA, 51 bp, Artificial Sequence
  source: /note="Description of Artificial Sequence: Synthetic heavy chain variable region CDR H2"
tggatgaaccctaacaatggtcacacaggctatgcacagagcttcgagggc

SEQ ID NO: 199 - protein, 11 aa, Artificial Sequence
  source: /note="Description of Artificial Sequence: Synthetic heavy chain variable region CDR H3"
VYNFWSDSSVS

SEQ ID NO: 200 - DNA, 33 bp, Artificial Sequence
  source: /note="Description of Artificial Sequence: Synthetic heavy chain variable region CDR H3"
gtatacaatttctggagtgattcttcagtctcc

SEQ ID NO: 201 - DNA, 333 bp, Artificial Sequence
  source: /note="Description of Artificial Sequence: Synthetic light chain variable region"
cagtctgtcgtgacgcagccgccctcagtgtctggggccccagggcagagtgtcgccatctcctgcactgggagcagctccaacatcgggccaggttatgatgtacactggtatcagcaacttccgggagcagcccccaaactcctcatctatggtgacagcaatcggccctcaggggtccctgaccgattctctacctccaagtctggcacctcagtttccctggccatcactgggctccaggctgaggatgaggctgattattactgccagtcctatgacagcagcctccgtggttatgtcttcggaactgggaccaagctcaccgtccta

SEQ ID NO: 202 - protein, 111 aa, Artificial Sequence
  source: /note="Description of Artificial Sequence: Synthetic light chain variable region"
QSVVTQPPSVSGAPGQSVAISCTGSSSNIGPGYDVHWYQQLPGAAPKLLIYGDSNRPSGVPDRFSTSKSGTSVSLAITGLQAEDEADYYCQSYDSSLRGYVFGTGTKLTVL

SEQ ID NO: 203 - protein, 14 aa, Artificial Sequence
  source: /note="Description of Artificial Sequence: Synthetic light chain variable region CDR L1"
TGSSSNIGPGYDVH

SEQ ID NO: 204 - DNA, 42 bp, Artificial Sequence
  source: /note="Description of Artificial Sequence: Synthetic light chain variable region CDR L1"
actgggagcagctccaacatcgggccaggttatgatgtacac

SEQ ID NO: 205 - protein, 7 aa, Artificial Sequence
  source: /note="Description of Artificial Sequence: Synthetic light chain variable region CDR L2"
GDSNRPS

SEQ ID NO: 206 - DNA, 21 bp, Artificial Sequence
  source: /note="Description of Artificial Sequence: Synthetic light chain variable region CDR L2"
ggtgacagcaatcggccctca

SEQ ID NO: 207 - protein, 11 aa, Artificial Sequence
  source: /note="Description of Artificial Sequence: Synthetic light chain variable region CDR L3"
QSYDSSLRGYV

SEQ ID NO: 208 - DNA, 33 bp, Artificial Sequence
  source: /note="Description of Artificial Sequence: Synthetic light chain variable region CDR L3"
cagtcctatgacagcagcctccgtggttatgtc

SEQ ID NO: 209 - DNA, 363 bp, Artificial Sequence
  source: /note="Description of Artificial Sequence: Synthetic heavy chain variable region"
caggtccagcttgtacagtctggagctgaggtgaagaagcctggggcctcagtgaaggtctcctgcaaggcttctggtttcacctttactaattatggtataagttgggtgcgacaggcccctggacgagggcttgagtggatgggctggatcagcgcttacaatggtaacacagagtatgcacagaagctccaagacagactcaccatgaccacagacacatctacgaacacagcctacatggagttgaggagcctgagatctgacgacacggccctatattattgtgcgagagagtcaggtgtcgcagcagctgctaccttactttactggggccagggaaccctggtcaccgtctcctca

SEQ ID NO: 210 - protein, 121 aa, Artificial Sequence
  source: /note="Description of Artificial Sequence: Synthetic heavy chain variable region"
QVQLVQSGAEVKKPGASVKVSCKASGFTFTNYGISWVRQAPGRGLEWMGWISAYNGNTEYAQKLQDRLTMTTDTSTNTAYMELRSLRSDDTALYYCARESGVAAAATLLYWGQGTLVTVSS

SEQ ID NO: 211 - protein, 9 aa, Artificial Sequence
  source: /note="Description of Artificial Sequence: Synthetic heavy chain variable region CDR H1"
FTFTNYGIS

SEQ ID NO: 212 - DNA, 27 bp, Artificial Sequence
  source: /note="Description of Artificial Sequence: Synthetic heavy chain variable region CDR H1"
ttcacctttactaattatggtataagt

SEQ ID NO: 213 - protein, 17 aa, Artificial Sequence
  source: /note="Description of Artificial Sequence: Synthetic heavy chain variable region CDR H2"
WISAYNGNTEYAQKLQD

SEQ ID NO: 214 - DNA, 51 bp, Artificial Sequence
  source: /note="Description of Artificial Sequence: Synthetic heavy chain variable region CDR H2"
tggatcagcgcttacaatggtaacacagagtatgcacagaagctccaagac

SEQ ID NO: 215 - protein, 14 aa, Artificial Sequence
  source: /note="Description of Artificial Sequence: Synthetic heavy chain variable region CDR H3"
ARESGVAAAATLLY

SEQ ID NO: 216 - DNA, 42 bp, Artificial Sequence
  source: /note="Description of Artificial Sequence: Synthetic heavy chain variable region CDR H3"
gcgagagagtcaggtgtcgcagcagctgctaccttactttac

SEQ ID NO: 217 - DNA, 336 bp, Artificial Sequence
  source: /note="Description of Artificial Sequence: Synthetic light chain variable region"
gaaacgacactcacgcagtctccactctccctgcccgtcacccttggacaaccggcctccatctcctgcaggtctagtcaaagcctcgtatacagcgatggaaacacctacttgagttggtttcagcagaggccaggccaatctccaaggcgcctaatttataaggtttctaaccgggactctggggtcccagacagattcagcggcagtgggtcaggcgctgatttcacactgaaaatcagcagggtggaggctgaggatgttggggtttattactgcatgcaaggtatatactggcctcggacgttcggccaagggaccaaagtggatatcaaa

SEQ ID NO: 218 - protein, 112 aa, Artificial Sequence
  source: /note="Description of Artificial Sequence: Synthetic light chain variable region"
ETTLTQSPLSLPVTLGQPASISCRSSQSLVYSDGNTYLSWFQQRPGQSPRRLIYKVSNRDSGVPDRFSGSGSGADFTLKISRVEAEDVGVYYCMQGIYWPRTFGQGTKVDIK

SEQ ID NO: 219 - protein, 16 aa, Artificial Sequence
  source: /note="Description of Artificial Sequence: Synthetic light chain variable region CDR L1"
RSSQSLVYSDGNTYLS

SEQ ID NO: 220 - DNA, 48 bp, Artificial Sequence
  source: /note="Description of Artificial Sequence: Synthetic light chain variable region CDR L1"
aggtctagtcaaagcctcgtatacagcgatggaaacacctacttgagt

SEQ ID NO: 221 - protein, 7 aa, Artificial Sequence
  source: /note="Description of Artificial Sequence: Synthetic light chain variable region CDR L2"
KVSNRDS

SEQ ID NO: 222 - DNA, 21 bp, Artificial Sequence
  source: /note="Description of Artificial Sequence: Synthetic light chain variable region CDR L2"
aaggtttctaaccgggactct

SEQ ID NO: 223 - protein, 9 aa, Artificial Sequence
  source: /note="Description of Artificial Sequence: Synthetic light chain variable region CDR L3"
MQGIYWPRT

SEQ ID NO: 224 - DNA, 27 bp, Artificial Sequence
  source: /note="Description of Artificial Sequence: Synthetic light chain variable region CDR L3"
atgcaaggtatatactggcctcggacg

SEQ ID NO: 225 - DNA, 390 bp, Artificial Sequence
  source: /note="Description of Artificial Sequence: Synthetic heavy chain variable region"
caggtgcagctggtggagtctggggctgaggtgcagaagcctggggcctcagtgaagatttcttgcaaggcatctggatacaagttcatcagctactccatacactgggtgcgacaggcccctggacaaggacttgagtggatgggagtaatcaaccctggtggcggtctcacaaactatgcacagaagttccaggacagactcaccatgaccagggacacgtccacggccacagtgaccatggaactgaggagcctgagatctgacgacagggccgtatatttttgtggtagagaagactcatattgtagtggagacagctgcttcaattccggttcggggcgctgggtcgactcctggggccagggaaccctggtcaccgtctcctca

SEQ ID NO: 226 - protein, 130 aa, Artificial Sequence
  source: /note="Description of Artificial Sequence: Synthetic heavy chain variable region"
QVQLVESGAEVQKPGASVKISCKASGYKFISYSIHWVRQAPGQGLEWMGVINPGGGLTNYAQKFQDRLTMTRDTSTATVTMELRSLRSDDRAVYFCGREDSYCSGDSCFNSGSGRWVDSWGQGTLVTVSS

SEQ ID NO: 227 - protein, 9 aa, Artificial Sequence
  source: /note="Description of Artificial Sequence: Synthetic heavy chain variable region CDR H1"
YKFISYSIH

SEQ ID NO: 228 - DNA, 27 bp, Artificial Sequence
  source: /note="Description of Artificial Sequence: Synthetic heavy chain variable region CDR H1"
tacaagttcatcagctactccatacac

SEQ ID NO: 229 - protein, 17 aa, Artificial Sequence
  source: /note="Description of Artificial Sequence: Synthetic heavy chain variable region CDR H2"
VINPGGGLTNYAQKFQD

SEQ ID NO: 230 - DNA, 51 bp, Artificial Sequence
  source: /note="Description of Artificial Sequence: Synthetic heavy chain variable region CDR H2"
gtaatcaaccctggtggcggtctcacaaactatgcacagaagttccaggac

SEQ ID NO: 231 - protein, 23 aa, Artificial Sequence
  source: /note="Description of Artificial Sequence: Synthetic heavy chain variable region CDR H3"
GREDSYCSGDSCFNSGSGRWVDS

SEQ ID NO: 232 - DNA, 69 bp, Artificial Sequence
  source: /note="Description of Artificial Sequence: Synthetic heavy chain variable region CDR H3"
ggtagagaagactcatattgtagtggagacagctgcttcaattccggttcggggcgctgggtcgactcc

SEQ ID NO: 233 - DNA, 321 bp, Artificial Sequence
  source: /note="Description of Artificial Sequence: Synthetic light chain variable region"
gacatccaggtgacccagtctccatcgtccctgtctgcatctgtcggagacagagtcaccatcacttgccgggcaagtcagagcgttatcacctatttaaattggtatcagcagaaaccagggaaagcccctcaactcctggtctatgctgcttccattttgcaaagtggggtcccatccagcttcagtggcagtggatctgggacagatttcactctcaccatcagcagtctgcaacctgaagattttgcaacttactactgtcaacagacttacagtacccctcatacttttggccaggggaccaaagtggatatcaaa

SEQ ID NO: 234 - protein, 107 aa, Artificial Sequence
  source: /note="Description of Artificial Sequence: Synthetic light chain variable region"
DIQVTQSPSSLSASVGDRVTITCRASQSVITYLNWYQQKPGKAPQLLVYAASILQSGVPSSFSGSGSGTDFTLTISSLQPEDFATYYCQQTYSTPHTFGQGTKVDIK

SEQ ID NO: 235 - protein, 11 aa, Artificial Sequence
  source: /note="Description of Artificial Sequence: Synthetic light chain variable region CDR L1"
RASQSVITYLN

SEQ ID NO: 236 - DNA, 33 bp, Artificial Sequence
  source: /note="Description of Artificial Sequence: Synthetic light chain variable region CDR L1"
cgggcaagtcagagcgttatcacctatttaaat

SEQ ID NO: 237 - protein, 7 aa, Artificial Sequence
  source: /note="Description of Artificial Sequence: Synthetic light chain variable region CDR L2"
AASILQS

SEQ ID NO: 238 - DNA, 21 bp, Artificial Sequence
  source: /note="Description of Artificial Sequence: Synthetic light chain variable region CDR L2"
gctgcttccattttgcaaagt

SEQ ID NO: 239 - protein, 9 aa, Artificial Sequence
  source: /note="Description of Artificial Sequence: Synthetic light chain variable region CDR L3"
QQTYSTPHT

SEQ ID NO: 240 - DNA, 27 bp, Artificial Sequence
  source: /note="Description of Artificial Sequence: Synthetic light chain variable region CDR L3"
caacagacttacagtacccctcatact

SEQ ID NO: 241 - DNA, 363 bp, Artificial Sequence
  source: /note="Description of Artificial Sequence: Synthetic heavy chain variable region"
gaggtgcagctggtggagtctggagctgaggtgaagaagcctggggcctcagtgaaggtctcctgcaaggcttctggttacacctttgccaactatggtatcacctgggtgcgacaggcccctggacaagggcttgagtacatgggatggatcagcgcttacaatggtaacacaaactatgcacagaagttccagggcagagtcaccatgaccacggacacatccacgagcacagcgtacatggagctgaggagcctgagatctgacgacacggccatttattactgtgcgagagatcccggtgttacggctgctgtgctacttgactactggggccagggagccctggtcaccgtctcctca

SEQ ID NO: 242 - protein, 121 aa, Artificial Sequence
  source: /note="Description of Artificial Sequence: Synthetic heavy chain variable region"
EVQLVESGAEVKKPGASVKVSCKASGYTFANYGITWVRQAPGQGLEYMGWISAYNGNTNYAQKFQGRVTMTTDTSTSTAYMELRSLRSDDTAIYYCARDPGVTAAVLLDYWGQGALVTVSS

SEQ ID NO: 243 - protein, 9 aa, Artificial Sequence
  source: /note="Description of Artificial Sequence: Synthetic heavy chain variable region CDR H1"
YTFANYGIT

SEQ ID NO: 244 - DNA, 27 bp, Artificial Sequence
  source: /note="Description of Artificial Sequence: Synthetic heavy chain variable region CDR H1"
tacacctttgccaactatggtatcacc

SEQ ID NO: 245 - protein, 17 aa, Artificial Sequence
  source: /note="Description of Artificial Sequence: Synthetic heavy chain variable region CDR H2"
WISAYNGNTNYAQKFQG

SEQ ID NO: 246 - DNA, 51 bp, Artificial Sequence
  source: /note="Description of Artificial Sequence: Synthetic heavy chain variable region CDR H2"
tggatcagcgcttacaatggtaacacaaactatgcacagaagttccagggc

SEQ ID NO: 247 - protein, 14 aa, Artificial Sequence
  source: /note="Description of Artificial Sequence: Synthetic heavy chain variable region CDR H3"
ARDPGVTAAVLLDY

SEQ ID NO: 248 - DNA, 42 bp, Artificial Sequence
  source: /note="Description of Artificial Sequence: Synthetic heavy chain variable region CDR H3"
gcgagagatcccggtgttacggctgctgtgctacttgactac

SEQ ID NO: 249 - DNA, 333 bp, Artificial Sequence
  source: /note="Description of Artificial Sequence: Synthetic light chain variable region"
gatattgtgttgacccagtctccactctccctgcccgtcacccttggacagccggcctccatctcctgcaggtctagtcaaagcctcgtattcagtgatggaaacacctacttgagttggtttcagcagaggccaggccaatctccaaggcgcctactttataaggtttctaaccgggactctggggtcccagacagattcagcggcagtgggtcaggcactgatttcacactgacaatcagcagggtggaggctgaggatgttggggtttattactgcttgcaaggtacacccccttacacttttggccaggggaccaaagtggatatcaaa

SEQ ID NO: 250 - protein, 111 aa, Artificial Sequence
  source: /note="Description of Artificial Sequence: Synthetic light chain variable region"
DIVLTQSPLSLPVTLGQPASISCRSSQSLVFSDGNTYLSWFQQRPGQSPRRLLYKVSNRDSGVPDRFSGSGSGTDFTLTISRVEAEDVGVYYCLQGTPPYTFGQGTKVDIK

SEQ ID NO: 251 - protein, 16 aa, Artificial Sequence
  source: /note="Description of Artificial Sequence: Synthetic light chain variable region CDR L1"
RSSQSLVFSDGNTYLS

SEQ ID NO: 252 - DNA, 48 bp, Artificial Sequence
  source: /note="Description of Artificial Sequence: Synthetic light chain variable region CDR L1"
aggtctagtcaaagcctcgtattcagtgatggaaacacctacttgagt

SEQ ID NO: 253 - protein, 7 aa, Artificial Sequence
  source: /note="Description of Artificial Sequence: Synthetic light chain variable region CDR L2"
KVSNRDS

SEQ ID NO: 254 - DNA, 21 bp, Artificial Sequence
  source: /note="Description of Artificial Sequence: Synthetic light chain variable region CDR L2"
aaggtttctaaccgggactct

SEQ ID NO: 255 - protein, 8 aa, Artificial Sequence
  source: /note="Description of Artificial Sequence: Synthetic light chain variable region CDR L3"
LQGTPPYT

SEQ ID NO: 256 - DNA, 24 bp, Artificial Sequence
  source: /note="Description of Artificial Sequence: Synthetic light chain variable region CDR L3"
ttgcaaggtacacccccttacact

SEQ ID NO: 257 - DNA, 363 bp, Artificial Sequence
  source: /note="Description of Artificial Sequence: Synthetic heavy chain variable region"
caggtgcagctggtggagtctgggggaggcgtggtccagcctgggaagtccctgagactctcctgtgcagcctctggattcaccttcagtagctatcctatgcactgggtccgccaggctccaggcgcggggctggagtggatggccgtaatctcatatgatggagccaataaatactatgaagactccttaaagggccgattcaccatctccagagacaattccaaggacactctgtttctgcaaatgaacaacctgagacctgaggacacggctgtctattactgtgcgagagggaggacttcgcatataaatacacccgagactaagtggggccagggaaccctggtcaccgtctcctca

SEQ ID NO: 258 - protein, 121 aa, Artificial Sequence
  source: /note="Description of Artificial Sequence: Synthetic heavy chain variable region"
QVQLVESGGGVVQPGKSLRLSCAASGFTFSSYPMHWVRQAPGAGLEWMAVISYDGANKYYEDSLKGRFTISRDNSKDTLFLQMNNLRPEDTAVYYCARGRTSHINTPETKWGQGTLVTVSS

SEQ ID NO: 259 - protein, 9 aa, Artificial Sequence
  source: /note="Description of Artificial Sequence: Synthetic heavy chain variable region CDR H1"
FTFSSYPMH

SEQ ID NO: 260 - DNA, 27 bp, Artificial Sequence
  source: /note="Description of Artificial Sequence: Synthetic heavy chain variable region CDR H1"
ttcaccttcagtagctatcctatgcac

SEQ ID NO: 261 - protein, 17 aa, Artificial Sequence
  source: /note="Description of Artificial Sequence: Synthetic heavy chain variable region CDR H2"
VISYDGANKYYEDSLKG

SEQ ID NO: 262 - DNA, 51 bp, Artificial Sequence
  source: /note="Description of Artificial Sequence: Synthetic heavy chain variable region CDR H2"
gtaatctcatatgatggagccaataaatactatgaagactccttaaagggc

SEQ ID NO: 263 - protein, 14 aa, Artificial Sequence
  source: /note="Description of Artificial Sequence: Synthetic heavy chain variable region CDR H3"
ARGRTSHINTPETK

SEQ ID NO: 264 - DNA, 42 bp, Artificial Sequence
  source: /note="Description of Artificial Sequence: Synthetic heavy chain variable region CDR H3"
gcgagagggaggacttcgcatataaatacacccgagactaag

SEQ ID NO: 265 - DNA, 321 bp, Artificial Sequence
  source: /note="Description of Artificial Sequence: Synthetic light chain variable region"
gaaattgtgttgacgcagtctccaaccttagtgtctgcatctacaggagacacagtcaccatcagttgccggatgagtcagggcattaacggttatttagcctggtttcagaaaaaaccagggaaagcccctgacctcctgatctatggtgcatccactttgcaagatggggtcccatcaaggttcagtggcagtggatctgggacagatttcactctcaccatcagtcgcctgcagtctgaagatttggcaacttattattgtcaacagtattacagtttgccgtggacgttcggccaagggaccaaagtggatatcaaa

SEQ ID NO: 266 - protein, 107 aa, Artificial Sequence
  source: /note="Description of Artificial Sequence: Synthetic light chain variable region"
EIVLTQSPTLVSASTGDTVTISCRMSQGINGYLAWFQKKPGKAPDLLIYGASTLQDGVPSRFSGSGSGTDFTLTISRLQSEDLATYYCQQYYSLPWTFGQGTKVDIK

SEQ ID NO: 267 - protein, 11 aa, Artificial Sequence
  source: /note="Description of Artificial Sequence: Synthetic light chain variable region CDR L1"
RMSQGINGYLA

SEQ ID NO: 268 - DNA, 33 bp, Artificial Sequence
  source: /note="Description of Artificial Sequence: Synthetic light chain variable region CDR L1"
cggatgagtcagggcattaacggttatttagcc

SEQ ID NO: 269 - protein, 7 aa, Artificial Sequence
  source: /note="Description of Artificial Sequence: Synthetic light chain variable region CDR L2"
GASTLQD

SEQ ID NO: 270 - DNA, 21 bp, Artificial Sequence
  source: /note="Description of Artificial Sequence: Synthetic light chain variable region CDR L2"
ggtgcatccactttgcaagat

SEQ ID NO: 271 - protein, 9 aa, Artificial Sequence
  source: /note="Description of Artificial Sequence: Synthetic light chain variable region CDR L3"
QQYYSLPWT

SEQ ID NO: 272 - DNA, 27 bp, Artificial Sequence
  source: /note="Description of Artificial Sequence: Synthetic light chain variable region CDR L3"
caacagtattacagtttgccgtggacg

SEQ ID NO: 273 - DNA, 351 bp, Artificial Sequence
  source: /note="Description of Artificial Sequence: Synthetic heavy chain variable region"
caggtccagcttgtacagtctggggctgaggtgaagaagcctggggcctcagtgaaggtctcctgcaaggcttctggatacagcttcaccgactactatatacactgggtgcgacaggcccctggacaagggcttgagtggataggatggatcaaccctaacagtggtggcacaacctttgcacagaactttcagggcagggtcaccatgaccagggacacgtccatcagcacagccttcctggagctgagcaggctaaaatctgacgacacggccgtatattattgtgcgagagacgttctctggttaaacggattctggggcctgggaaccctggtcaccgtctcttca

SEQ ID NO: 274 - protein, 117 aa, Artificial Sequence
  source: /note="Description of Artificial Sequence: Synthetic heavy chain variable region"
QVQLVQSGAEVKKPGASVKVSCKASGYSFTDYYIHWVRQAPGQGLEWIGWINPNSGGTTFAQNFQGRVTMTRDTSISTAFLELSRLKSDDTAVYYCARDVLWLNGFWGLGTLVTVSS

SEQ ID NO: 275 - protein, 9 aa, Artificial Sequence
  source: /note="Description of Artificial Sequence: Synthetic heavy chain variable region CDR H1"
YSFTDYYIH

SEQ ID NO: 276 - DNA, 27 bp, Artificial Sequence
  source: /note="Description of Artificial Sequence: Synthetic heavy chain variable region CDR H1"
tacagcttcaccgactactatatacac

SEQ ID NO: 277 - protein, 17 aa, Artificial Sequence
  source: /note="Description of Artificial Sequence: Synthetic heavy chain variable region CDR H2"
WINPNSGGTTFAQNFQG

SEQ ID NO: 278 - DNA, 51 bp, Artificial Sequence
  source: /note="Description of Artificial Sequence: Synthetic heavy chain variable region CDR H2"
tggatcaaccctaacagtggtggcacaacctttgcacagaactttcagggc

SEQ ID NO: 279 - protein, 10 aa, Artificial Sequence
  source: /note="Description of Artificial Sequence: Synthetic heavy chain variable region CDR H3"
ARDVLWLNGF

SEQ ID NO: 280 - DNA, 30 bp, Artificial Sequence
  source: /note="Description of Artificial Sequence: Synthetic heavy chain variable region CDR H3"
gcgagagacgttctctggttaaacggattc

SEQ ID NO: 281 - DNA, 339 bp, Artificial Sequence
  source: /note="Description of Artificial Sequence: Synthetic light chain variable region"
cagtctgtggtgacgcagccgccctcagtgtctgcggccccaggacagaaggtcaccatctcctgctctggaagcagctccaacattgggaataattatgtatcctggtatcagcagttccgaggaacagcccccaaagtcctcatttatgaaaataataagcgaacctcagggattcctgaccgattctctggctccaagtctggcacgtcagccaccctgggcatcaccggactccagactggggacgaggccgattattactgcggaacatgggatagcagcctgagtactggcccctatgtggtattcggcggagggaccaagctgaccgtccta

SEQ ID NO: 282 - protein, 113 aa, Artificial Sequence
  source: /note="Description of Artificial Sequence: Synthetic light chain variable region"
QSVVTQPPSVSAAPGQKVTISCSGSSSNIGNNYVSWYQQFRGTAPKVLIYENNKRTSGIPDRFSGSKSGTSATLGITGLQTGDEADYYCGTWDSSLSTGPYVVFGGGTKLTVL

SEQ ID NO: 283 - protein, 13 aa, Artificial Sequence
  source: /note="Description of Artificial Sequence: Synthetic light chain variable region CDR L1"
SGSSSNIGNNYVS

SEQ ID NO: 284 - DNA, 39 bp, Artificial Sequence
  source: /note="Description of Artificial Sequence: Synthetic light chain variable region CDR L1"
tctggaagcagctccaacattgggaataattatgtatcc

SEQ ID NO: 285 - protein, 7 aa, Artificial Sequence
  source: /note="Description of Artificial Sequence: Synthetic light chain variable region CDR L2"
ENNKRTS

SEQ ID NO: 286 - DNA, 21 bp, Artificial Sequence
  source: /note="Description of Artificial Sequence: Synthetic light chain variable region CDR L2"
gaaaataataagcgaacctca

SEQ ID NO: 287 - protein, 14 aa, Artificial Sequence
  source: /note="Description of Artificial Sequence: Synthetic light chain variable region CDR L3"
GTWDSSLSTGPYVV

SEQ ID NO: 288 - DNA, 42 bp, Artificial Sequence
  source: /note="Description of Artificial Sequence: Synthetic light chain variable region CDR L3"
ggaacatgggatagcagcctgagtactggcccctatgtggta

SEQ ID NO: 289 - DNA, 372 bp, Artificial Sequence
  source: /note="Description of Artificial Sequence: Synthetic heavy chain variable region"
caggtccagctggtgcagtctggggctgaggcgaagaagcctggggcctcagtgaaggtttcctgtaaggcatctggatatacctttaccagctactatttgcactgggtgcgacaggcccctggacaagggcctgagtggatgggaataatcaaccctggtggtggtagcacagagttgtcacagaagttccagggcagagtcaccttgactagggacacgtccacgagcacagtctacatggaggtgaccagcctgacatctgaggacacggccgtctattactgtgcgagagcccggatacagctctgggcaccaaattactacggtatggacgtctggggccaagggaccacggtcaccgtctcttca

SEQ ID NO: 290 - protein, 124 aa, Artificial Sequence
  source: /note="Description of Artificial Sequence: Synthetic heavy chain variable region"
QVQLVQSGAEAKKPGASVKVSCKASGYTFTSYYLHWVRQAPGQGPEWMGIINPGGGSTELSQKFQGRVTLTRDTSTSTVYMEVTSLTSEDTAVYYCARARIQLWAPNYYGMDVWGQGTTVTVSS

SEQ ID NO: 291 - protein, 9 aa, Artificial Sequence
  source: /note="Description of Artificial Sequence: Synthetic heavy chain variable region CDR H1"
YTFTSYYLH

SEQ ID NO: 292 - DNA, 27 bp, Artificial Sequence
  source: /note="Description of Artificial Sequence: Synthetic heavy chain variable region CDR H1"
tatacctttaccagctactatttgcac

SEQ ID NO: 293 - protein, 17 aa, Artificial Sequence
  source: /note="Description of Artificial Sequence: Synthetic heavy chain variable region CDR H2"
IINPGGGSTELSQKFQG

SEQ ID NO: 294 - DNA, 51 bp, Artificial Sequence
  source: /note="Description of Artificial Sequence: Synthetic heavy chain variable region CDR H2"
ataatcaaccctggtggtggtagcacagagttgtcacagaagttccagggc

SEQ ID NO: 295 - protein, 17 aa, Artificial Sequence
  source: /note="Description of Artificial Sequence: Synthetic heavy chain variable region CDR H3"
ARARIQLWAPNYYGMDV

SEQ ID NO: 296 - DNA, 51 bp, Artificial Sequence
  source: /note="Description of Artificial Sequence: Synthetic heavy chain variable region CDR H3"
gcgagagcccggatacagctctgggcaccaaattactacggtatggacgtc

SEQ ID NO: 297 - DNA, 321 bp, Artificial Sequence
  source: /note="Description of Artificial Sequence: Synthetic light chain variable region"
gacatccagttgacccagtctccatccttcctgtctgcatctgtaggagacagagtcaccatcacttgccgggccagtcatggcattaccagttatttagcctggtatcagcaaaaaccagggaatgcccctaagctcctgatctatgctgcatccactttgcaaagtggggtcccatcaaggttcagcggcagtgggtctgagacacagttcactctcacaatcagcggcctgcagcctgaagattttgcaacttattactgtcaacagcttaatcgttaccctctaacgttcggccaagggaccaaggtggaaatcaaa

SEQ ID NO: 298 - protein, 107 aa, Artificial Sequence
  source: /note="Description of Artificial Sequence: Synthetic light chain variable region"
DIQLTQSPSFLSASVGDRVTITCRASHGITSYLAWYQQKPGNAPKLLIYAASTLQSGVPSRFSGSGSETQFTLTISGLQPEDFATYYCQQLNRYPLTFGQGTKVEIK

SEQ ID NO: 299 - protein, 11 aa, Artificial Sequence
  source: /note="Description of Artificial Sequence: Synthetic light chain variable region CDR L1"
RASHGITSYLA

SEQ ID NO: 300 - DNA, 33 bp, Artificial Sequence
  source: /note="Description of Artificial Sequence: Synthetic light chain variable region CDR L1"
cgggccagtcatggcattaccagttatttagcc

SEQ ID NO: 301 - protein, 7 aa, Artificial Sequence
  source: /note="Description of Artificial Sequence: Synthetic light chain variable region CDR L2"
AASTLQS

SEQ ID NO: 302 - DNA, 21 bp, Artificial Sequence
  source: /note="Description of Artificial Sequence: Synthetic light chain variable region CDR L2"
gctgcatccactttgcaaagt

SEQ ID NO: 303 - protein, 9 aa, Artificial Sequence
  source: /note="Description of Artificial Sequence: Synthetic light chain variable region CDR L3"
QQLNRYPLT

SEQ ID NO: 304 - DNA, 27 bp, Artificial Sequence
  source: /note="Description of Artificial Sequence: Synthetic light chain variable region CDR L3"
caacagcttaatcgttaccctctaacg

SEQ ID NO: 305 - DNA, 360 bp, Artificial Sequence
  source: /note="Description of Artificial Sequence: Synthetic heavy chain variable region"
caggtccagcttgtgcagtctggagctgaggtgaagaagcctggggcctcagtgaagatctcctgcaagacctctggttacacctttacgagctctgtgatcagctgggtgcggcaggcccctggacaagggcttgagtgggtgggatggatcaccggtcacagaagtagcacaaactatgcacagagactccagggtagagtcaccatgaccacagacacatccacgagcacagcctatatggagctgaggagcctgaggtctgacgacacggccgtgtattactgtgcgagagccgatggtggttcggggagttattatagcgcctggggccagggaaccctggtcaccgtctcctca

SEQ ID NO: 306 - protein, 120 aa, Artificial Sequence
  source: /note="Description of Artificial Sequence: Synthetic heavy chain variable region"
QVQLVQSGAEVKKPGASVKISCKTSGYTFTSSVISWVRQAPGQGLEWVGWITGHRSSTNYAQRLQGRVTMTTDTSTSTAYMELRSLRSDDTAVYYCARADGGSGSYYSAWGQGTLVTVSS

SEQ ID NO: 307 - protein, 9 aa, Artificial Sequence
  source: /note="Description of Artificial Sequence: Synthetic heavy chain variable region CDR H1"
YTFTSSVIS

SEQ ID NO: 308 - DNA, 27 bp, Artificial Sequence
  source: /note="Description of Artificial Sequence: Synthetic heavy chain variable region CDR H1"
tacacctttacgagctctgtgatcagc

SEQ ID NO: 309 - protein, 17 aa, Artificial Sequence
  source: /note="Description of Artificial Sequence: Synthetic heavy chain variable region CDR H2"
WITGHRSSTNYAQRLQG

SEQ ID NO: 310 - DNA, 51 bp, Artificial Sequence
  source: /note="Description of Artificial Sequence: Synthetic heavy chain variable region CDR H2"
tggatcaccggtcacagaagtagcacaaactatgcacagagactccagggt

SEQ ID NO: 311 - protein, 13 aa, Artificial Sequence
  source: /note="Description of Artificial Sequence: Synthetic heavy chain variable region CDR H3"
ARADGGSGSYYSA

SEQ ID NO: 312 - DNA, 39 bp, Artificial Sequence
  source: /note="Description of Artificial Sequence: Synthetic heavy chain variable region CDR H3"
gcgagagccgatggtggttcggggagttattatagcgcc

SEQ ID NO: 313 - DNA, 324 bp, Artificial Sequence
  source: /note="Description of Artificial Sequence: Synthetic light chain variable region"
tcctatgagctgacacagccaccctcagcgtcagtggccccaggaaagacggccaggatctcctgtgggggaaacaacattggaactaagagtgtccactggtaccagcagaagccaggccaggcccctgtcttggtcatctatcatgatagccaccggccctcagggatccctgagcgattctctggctccaactctgggaacacggccaccctgaccatcagtagggtcgaagccggggatgaggccgactattattgtcagctgtgggatagtagtagtgattcccatgtcttcggaactgggaccaagctcaccgtccta

SEQ ID NO: 314 - protein, 108 aa, Artificial Sequence
  source: /note="Description of Artificial Sequence: Synthetic light chain variable region"
SYELTQPPSASVAPGKTARISCGGNNIGTKSVHWYQQKPGQAPVLVIYHDSHRPSGIPERFSGSNSGNTATLTISRVEAGDEADYYCQLWDSSSDSHVFGTGTKLTVL

SEQ ID NO: 315 - protein, 11 aa, Artificial Sequence
  source: /note="Description of Artificial Sequence: Synthetic light chain variable region CDR L1"
GGNNIGTKSVH

SEQ ID NO: 316 - DNA, 33 bp, Artificial Sequence
  source: /note="Description of Artificial Sequence: Synthetic light chain variable region CDR L1"
gggggaaacaacattggaactaagagtgtccac

SEQ ID NO: 317 - protein, 7 aa, Artificial Sequence
  source: /note="Description of Artificial Sequence: Synthetic light chain variable region CDR L2"
HDSHRPS

SEQ ID NO: 318 - DNA, 21 bp, Artificial Sequence
  source: /note="Description of Artificial Sequence: Synthetic light chain variable region CDR L2"
catgatagccaccggccctca

SEQ ID NO: 319 - protein, 11 aa, Artificial Sequence
  source: /note="Description of Artificial Sequence: Synthetic light chain variable region CDR L3"
QLWDSSSDSHV

SEQ ID NO: 320 - DNA, 33 bp, Artificial Sequence
  source: /note="Description of Artificial Sequence: Synthetic light chain variable region CDR L3"
cagctgtgggatagtagtagtgattcccatgtc

SEQ ID NO: 321 - DNA, 357 bp, Artificial Sequence
  source: /note="Description of Artificial Sequence: Synthetic heavy chain variable region"
caggtgcagctggtgcagtctgggggaggcctggtcaagcctggggggtccctgagactctcctgtgcagcctcgggattcaccatcagtggttataacatgttctgggtccgccagcctccggggaaggggctggagtgggtctcatccattactgctggtagtagttatttaaactatgcagactcagtgaagggccgtttcatcgtctccagagacaacgccaagaattcactgtatctgcaaatgaacagcctgagagccgaggacacggctgtttatttctgtgcgagagcacctcttttacccgctatgatggacctctggggccaagggaccacggtcaccgtctcctca

SEQ ID NO: 322 - protein, 119 aa, Artificial Sequence
  source: /note="Description of Artificial Sequence: Synthetic heavy chain variable region"
QVQLVQSGGGLVKPGGSLRLSCAASGFTISGYNMFWVRQPPGKGLEWVSSITAGSSYLNYADSVKGRFIVSRDNAKNSLYLQMNSLRAEDTAVYFCARAPLLPAMMDLWGQGTTVTVSS

SEQ ID NO: 323 - protein, 9 aa, Artificial Sequence
  source: /note="Description of Artificial Sequence: Synthetic heavy chain variable region CDR H1"
FTISGYNMF

SEQ ID NO: 324 - DNA, 27 bp, Artificial Sequence
  source: /note="Description of Artificial Sequence: Synthetic heavy chain variable region CDR H1"
ttcaccatcagtggttataacatgttc

SEQ ID NO: 325 - protein, 17 aa, Artificial Sequence
  source: /note="Description of Artificial Sequence: Synthetic heavy chain variable region CDR H2"
SITAGSSYLNYADSVKG

SEQ ID NO: 326 - DNA, 51 bp, Artificial Sequence
  source: /note="Description of Artificial Sequence: Synthetic heavy chain variable region CDR H2"
tccattactgctggtagtagttatttaaactatgcagactcagtgaagggc

SEQ ID NO: 327 - protein, 12 aa, Artificial Sequence
  source: /note="Description of Artificial Sequence: Synthetic heavy chain variable region CDR H3"
ARAPLLPAMMDL

SEQ ID NO: 328 - DNA, 36 bp, Artificial Sequence
  source: /note="Description of Artificial Sequence: Synthetic heavy chain variable region CDR H3"
gcgagagcacctcttttacccgctatgatggacctc

SEQ ID NO: 329 - DNA, 333 bp, Artificial Sequence
  source: /note="Description of Artificial Sequence: Synthetic light chain variable region"
cagtctgtcttgacgcagccgccctcagtgtctggggccccagggcagagggtcaccatctcctgcactgggagcagctccaacatcggggcaggttatgatgtacactggtaccagcaacttccaggaacagcccccaaactcctcatctatactaacaacaatcggccctcaggggtccctgaccgattctctggctccaagtctggcacctcagcctccctggccatcactgggctccaggctgaggatgaggctgactattactgccagtcctatgacagaagcctgaatggttatgtcttcggaactgggaccaagctcaccgtccta

SEQ ID NO: 330 - protein, 111 aa, Artificial Sequence
  source: /note="Description of Artificial Sequence: Synthetic light chain variable region"
QSVLTQPPSVSGAPGQRVTISCTGSSSNIGAGYDVHWYQQLPGTAPKLLIYTNNNRPSGVPDRFSGSKSGTSASLAITGLQAEDEADYYCQSYDRSLNGYVFGTGTKLTVL

SEQ ID NO: 331 - protein, 14 aa, Artificial Sequence
  source: /note="Description of Artificial Sequence: Synthetic light chain variable region CDR L1"
TGSSSNIGAGYDVH

SEQ ID NO: 332 - DNA, 42 bp, Artificial Sequence; identical to SEQ ID NO: 60
  source: /note="Description of Artificial Sequence: Synthetic light chain variable region CDR L1"

SEQ ID NO: 333 - protein, 7 aa, Artificial Sequence
  source: /note="Description of Artificial Sequence: Synthetic light chain variable region CDR L2"
TNNNRPS

SEQ ID NO: 334 - DNA, 21 bp, Artificial Sequence
  source: /note="Description of Artificial Sequence: Synthetic light chain variable region CDR L2"
actaacaacaatcggccctca

SEQ ID NO: 335 - protein, 11 aa, Artificial Sequence
  source: /note="Description of Artificial Sequence: Synthetic light chain variable region CDR L3"
QSYDRSLNGYV

SEQ ID NO: 336 - DNA, 33 bp, Artificial Sequence
  source: /note="Description of Artificial Sequence: Synthetic light chain variable region CDR L3"
cagtcctatgacagaagcctgaatggttatgtc

SEQ ID NO: 337 - DNA, 351 bp, Artificial Sequence
  source: /note="Description of Artificial Sequence: Synthetic heavy chain variable region"
caggtccagcttgtacagtctggggctgaggtgaagaagcctggggcctcactgatggtctcctgctcggcttctggatacattttcaacagtgacatcaactgggtgcgacaggcccctggacaagggcttgagtggatggggtggatgaaccctaagaatggtcacacaggctatgcacaggaattcgagggcagagtcagcatgaccaggaactcctccaaaactattgcctatctgcagctgagcagcctgacatatgaagacacggccgtctattattgtgtttacgatttctggagtgatgattcagtcaagtggggccggggaaccctggtcaccgtctcctca

SEQ ID NO: 338 - protein, 117 aa, Artificial Sequence
  source: /note="Description of Artificial Sequence: Synthetic heavy chain variable region"
QVQLVQSGAEVKKPGASLMVSCSASGYIFNSDINWVRQAPGQGLEWMGWMNPKNGHTGYAQEFEGRVSMTRNSSKTIAYLQLSSLTYEDTAVYYCVYDFWSDDSVKWGRGTLVTVSS

SEQ ID NO: 339 - protein, 8 aa, Artificial Sequence
  source: /note="Description of Artificial Sequence: Synthetic heavy chain variable region CDR H1"
YIFNSDIN

SEQ ID NO: 340 - DNA, 24 bp, Artificial Sequence
  source: /note="Description of Artificial Sequence: Synthetic heavy chain variable region CDR H1"
tacattttcaacagtgacatcaac

SEQ ID NO: 341 - protein, 17 aa, Artificial Sequence
  source: /note="Description of Artificial Sequence: Synthetic heavy chain variable region CDR H2"
WMNPKNGHTGYAQEFEG

SEQ ID NO: 342 - DNA, 51 bp, Artificial Sequence
  source: /note="Description of Artificial Sequence: Synthetic heavy chain variable region CDR H2"
tggatgaaccctaagaatggtcacacaggctatgcacaggaattcgagggc

SEQ ID NO: 343 - protein, 11 aa, Artificial Sequence
  source: /note="Description of Artificial Sequence: Synthetic heavy chain variable region CDR H3"
VYDFWSDDSVK

SEQ ID NO: 344 - DNA, 33 bp, Artificial Sequence
  source: /note="Description of Artificial Sequence: Synthetic heavy chain variable region CDR H3"
gtttacgatttctggagtgatgattcagtcaag

SEQ ID NO: 345 - DNA, 333 bp, Artificial Sequence
  source: /note="Description of Artificial Sequence: Synthetic light chain variable region"
cagtctgtggtgacgcagccgccctcagtgtctggggccccagggcagagtgtcgccatctcctgctctgggagcagctccaacatcgggccaggttatgatgtacactggtaccagcaacttccgggatcagcccccaaactcctcatctacggtgacaacaatcggccctcaggggtccctgagcgattctctacctccaagtctggcacctcagcctcactggccatcactgggctccaggctgaggatgaggctgattattactgccagtcctttgacagcagcctgcgtggttatgtcttcggaactgggaccaaggtgaccgtccta

SEQ ID NO: 346 - protein, 111 aa, Artificial Sequence
  source: /note="Description of Artificial Sequence: Synthetic light chain variable region"
QSVVTQPPSVSGAPGQSVAISCSGSSSNIGPGYDVHWYQQLPGSAPKLLIYGDNNRPSGVPERFSTSKSGTSASLAITGLQAEDEADYYCQSFDSSLRGYVFGTGTKVTVL

SEQ ID NO: 347 - protein, 14 aa, Artificial Sequence
  source: /note="Description of Artificial Sequence: Synthetic light chain variable region CDR L1"
SGSSSNIGPGYDVH

SEQ ID NO: 348 - DNA, 42 bp, Artificial Sequence
  source: /note="Description of Artificial Sequence: Synthetic light chain variable region CDR L1"
tctgggagcagctccaacatcgggccaggttatgatgtacac

SEQ ID NO: 349 - protein, 7 aa, Artificial Sequence
  source: /note="Description of Artificial Sequence: Synthetic light chain variable region CDR L2"
GDNNRPS

SEQ ID NO: 350 - DNA, 21 bp, Artificial Sequence
  source: /note="Description of Artificial Sequence: Synthetic light chain variable region CDR L2"
ggtgacaacaatcggccctca

SEQ ID NO: 351 - protein, 11 aa, Artificial Sequence
  source: /note="Description of Artificial Sequence: Synthetic light chain variable region CDR L3"
QSFDSSLRGYV

SEQ ID NO: 352 - DNA, 33 bp, Artificial Sequence
  source: /note="Description of Artificial Sequence: Synthetic light chain variable region CDR L3"
cagtcctttgacagcagcctgcgtggttatgtc

SEQ ID NO: 353 - DNA, 381 bp, Artificial Sequence
  source: /note="Description of Artificial Sequence: Synthetic heavy chain variable region"
caggtccagctggtacagtctggagcagcggtgaaaaagcccggggagtctctgaagatctcctgtaagggttttggatacagctttaccaagtattggatcggctgggtgcgccaggtgcccgggaaaggcctggagtggatagggatcatctctcctactgactctaataccagatacagcccgtccttccgaggccaggtcaccatgtcagccgacaagtccatcagtgccgcctacctgcagtggagcagcctgaaggcctcggacaccgccatgtattactgtgcgagacacagcagtccgtatagcagtggctggtacggagatacatacttctttgactcctggggccagggaaccctggtcaccgtctcctca

SEQ ID NO: 354 - protein, 127 aa, Artificial Sequence
  source: /note="Description of Artificial Sequence: Synthetic heavy chain variable region"
QVQLVQSGAAVKKPGESLKISCKGFGYSFTKYWIGWVRQVPGKGLEWIGIISPTDSNTRYSPSFRGQVTMSADKSISAAYLQWSSLKASDTAMYYCARHSSPYSSGWYGDTYFFDSWGQGTLVTVSS

SEQ ID NO: 355 - protein, 9 aa, Artificial Sequence
  source: /note="Description of Artificial Sequence: Synthetic heavy chain variable region CDR H1"
YSFTKYWIG

SEQ ID NO: 356 - DNA, 27 bp, Artificial Sequence
  source: /note="Description of Artificial Sequence: Synthetic heavy chain variable region CDR H1"
tacagctttaccaagtattggatcggc

SEQ ID NO: 357 - protein, 17 aa, Artificial Sequence
  source: /note="Description of Artificial Sequence: Synthetic heavy chain variable region CDR H2"
IISPTDSNTRYSPSFRG

SEQ ID NO: 358 - DNA, 51 bp, Artificial Sequence
  source: /note="Description of Artificial Sequence: Synthetic heavy chain variable region CDR H2"
atcatctctcctactgactctaataccagatacagcccgtccttccgaggc

SEQ ID NO: 359 - protein, 20 aa, Artificial Sequence
  source: /note="Description of Artificial Sequence: Synthetic heavy chain variable region CDR H3"
ARHSSPYSSGWYGDTYFFDS

SEQ ID NO: 360 - DNA, 60 bp, Artificial Sequence
  source: /note="Description of Artificial Sequence: Synthetic heavy chain variable region CDR H3"
gcgagacacagcagtccgtatagcagtggctggtacggagatacatacttctttgactcc

SEQ ID NO: 361 - DNA, 330 bp, Artificial Sequence
  source: /note="Description of Artificial Sequence: Synthetic light chain variable region"
cagcctgtgctgactcagccaccctcagcgtctgggacccccgggcagagggtcaccatctcttgttctggaagcaactccaacatcgggactaatactgtgaactggtaccagcagctccctggaacggcccccaaagtcctcatccataataataatgagcggccctcaggggtccctgaccgattctctggctccaagtctggcacctcagcctccctggccatcagtgggctccagtctgaggatgaggctgattattactgtgcagcatgggatgacagcctgagaggttatgtcttcggaactgggaccaaggtgaccgtccta

SEQ ID NO: 362 - protein, 110 aa, Artificial Sequence
  source: /note="Description of Artificial Sequence: Synthetic light chain variable region"
QPVLTQPPSASGTPGQRVTISCSGSNSNIGTNTVNWYQQLPGTAPKVLIHNNNERPSGVPDRFSGSKSGTSASLAISGLQSEDEADYYCAAWDDSLRGYVFGTGTKVTVL

SEQ ID NO: 363 - protein, 13 aa, Artificial Sequence
  source: /note="Description of Artificial Sequence: Synthetic light chain variable region CDR L1"
SGSNSNIGTNTVN

SEQ ID NO: 364 - DNA, 39 bp, Artificial Sequence
  source: /note="Description of Artificial Sequence: Synthetic light chain variable region CDR L1"
tctggaagcaactccaacatcgggactaatactgtgaac

SEQ ID NO: 365 - protein, 7 aa, Artificial Sequence
  source: /note="Description of Artificial Sequence: Synthetic light chain variable region CDR L2"
NNNERPS

SEQ ID NO: 366 - DNA, 21 bp, Artificial Sequence
  source: /note="Description of Artificial Sequence: Synthetic light chain variable region CDR L2"
aataataatgagcggccctca

SEQ ID NO: 367 - protein, 11 aa, Artificial Sequence
  source: /note="Description of Artificial Sequence: Synthetic light chain variable region CDR L3"
AAWDDSLRGYV

SEQ ID NO: 368 - DNA, 33 bp, Artificial Sequence
  source: /note="Description of Artificial Sequence: Synthetic light chain variable region CDR L3"
gcagcatgggatgacagcctgagaggttatgtc

SEQ ID NO: 369 - DNA, 390 bp, Artificial Sequence
  source: /note="Description of Artificial Sequence: Synthetic heavy chain variable region"
caggtgcagctggtgcaatctggggctgaggtgaagaagcctgggtcctcggtgaaggtctcctgcaaggcttctggaggcaccttcggcagctatgctatcagctgggtgcgacaggcccctggacaaggacttgagtggatgggagggaccatccctatctttggtacagcagaccacgcacagaagttccagggcagagtcacgataaccgcggacaaatccacgagcacagcgtacatggaactgagcagcctgagatctgaggacacggccgtgtattactgtgcgagaggtgttttccgcgtaggttgtagtgataccagctgcctcaaaaactactacggtacggacgtctggggccaagggaccacggtcaccgtctcctca

SEQ ID NO: 370 - protein, 130 aa, Artificial Sequence
  source: /note="Description of Artificial Sequence: Synthetic heavy chain variable region"
QVQLVQSGAEVKKPGSSVKVSCKASGGTFGSYAISWVRQAPGQGLEWMGGTIPIFGTADHAQKFQGRVTITADKSTSTAYMELSSLRSEDTAVYYCARGVFRVGCSDTSCLKNYYGTDVWGQGTTVTVSS

SEQ ID NO: 371 - protein, 9 aa, Artificial Sequence
  source: /note="Description of Artificial Sequence: Synthetic heavy chain variable region CDR H1"
GTFGSYAIS

SEQ ID NO: 372 - DNA, 27 bp, Artificial Sequence
  source: /note="Description of Artificial Sequence: Synthetic heavy chain variable region CDR H1"
ggcaccttcggcagctatgctatcagc

SEQ ID NO: 373 - protein, 17 aa, Artificial Sequence
  source: /note="Description of Artificial Sequence: Synthetic heavy chain variable region CDR H2"
GTIPIFGTADHAQKFQG

SEQ ID NO: 374 - DNA, 51 bp, Artificial Sequence
  source: /note="Description of Artificial Sequence: Synthetic heavy chain variable region CDR H2"
gggaccatccctatctttggtacagcagaccacgcacagaagttccagggc

SEQ ID NO: 375 - protein, 23 aa, Artificial Sequence
  source: /note="Description of Artificial Sequence: Synthetic heavy chain variable region CDR H3"
ARGVFRVGCSDTSCLKNYYGTDV

SEQ ID NO: 376 - DNA, 69 bp, Artificial Sequence
  source: /note="Description of Artificial Sequence: Synthetic heavy chain variable region CDR H3"
gcgagaggtgttttccgcgtaggttgtagtgataccagctgcctcaaaaactactacggtacggacgtc

SEQ ID NO: 377 - DNA, 333 bp, Artificial Sequence
  source: /note="Description of Artificial Sequence: Synthetic light chain variable region"
cagtctgttctgattcagcctgcctccgtgtctgggtctcctggacagtcgatcaccgtctcctgcactggatccagcggtgacgttggtgcttataagtatgtctcctggtaccaacaacacccaggcagaggccccaaactcataatttatgatgtcagtgctcggccctcagggatttctgatcgcttctctggctccaagtctggcaacacggcctccctgaccatctctgggctccaggctgaggacgaggctgactattactgcagctcatattcaagcagcagcactctcgtagtattcggcggagggaccaaggtgaccgtccta

SEQ ID NO: 378 - protein, 111 aa, Artificial Sequence
  source: /note="Description of Artificial Sequence: Synthetic light chain variable region"
QSVLIQPASVSGSPGQSITVSCTGSSGDVGAYKYVSWYQQHPGRGPKLIIYDVSARPSGISDRFSGSKSGNTASLTISGLQAEDEADYYCSSYSSSSTLVVFGGGTKVTVL

SEQ ID NO: 379 - protein, 14 aa, Artificial Sequence
  source: /note="Description of Artificial Sequence: Synthetic light chain variable region CDR L1"
TGSSGDVGAYKYVS

SEQ ID NO: 380 - DNA, 42 bp, Artificial Sequence
  source: /note="Description of Artificial Sequence: Synthetic light chain variable region CDR L1"
actggatccagcggtgacgttggtgcttataagtatgtctcc

SEQ ID NO: 381 - protein, 7 aa, Artificial Sequence
  source: /note="Description of Artificial Sequence: Synthetic light chain variable region CDR L2"
DVSARPS

SEQ ID NO: 382 - DNA, 21 bp, Artificial Sequence
  source: /note="Description of Artificial Sequence: Synthetic light chain variable region CDR L2"
gatgtcagtgctcggccctca

SEQ ID NO: 383 - protein, 11 aa, Artificial Sequence
  source: /note="Description of Artificial Sequence: Synthetic light chain variable region CDR L3"
SSYSSSSTLVV

SEQ ID NO: 384 - DNA, 33 bp, Artificial Sequence
  source: /note="Description of Artificial Sequence: Synthetic light chain variable region CDR L3"
agctcatattcaagcagcagcactctcgtagta

SEQ ID NO: 385 - DNA, 375 bp, Artificial Sequence
  source: /note="Description of Artificial Sequence: Synthetic heavy chain variable region"
caggtccagctggtgcagtctgggggagggttggtgcagcctggggggtccctgagactctcttgtgtaggctctggattcaccttcagtacctatagtatgaactgggtccgtcaggctccagggaaggggctggagtgggtttcacacattagtagtagtagtgttaccatgtactacgcagactttgtgaagggccgattcaccatctccagagacaatgccaagaactcactgtatctgcaaatgaccagcctgagagccgaggacacggctgtgtattactgtgcgagagatgcgggaccagtttggagtggttattacgactacggtatggacgtctggggccaagggaccacggtcactgtctcctca

SEQ ID NO: 386 - protein, 125 aa, Artificial Sequence
  source: /note="Description of Artificial Sequence: Synthetic heavy chain variable region"
QVQLVQSGGGLVQPGGSLRLSCVGSGFTFSTYSMNWVRQAPGKGLEWVSHISSSSVTMYYADFVKGRFTISRDNAKNSLYLQMTSLRAEDTAVYYCARDAGPVWSGYYDYGMDVWGQGTTVTVSS

SEQ ID NO: 387 - protein, 9 aa, Artificial Sequence
  source: /note="Description of Artificial Sequence: Synthetic heavy chain variable region CDR H1"
FTFSTYSMN

SEQ ID NO: 388 - DNA, 27 bp, Artificial Sequence
  source: /note="Description of Artificial Sequence: Synthetic heavy chain variable region CDR H1"
ttcaccttcagtacctatagtatgaac

SEQ ID NO: 389 - protein, 17 aa, Artificial Sequence
  source: /note="Description of Artificial Sequence: Synthetic heavy chain variable region CDR H2"
HISSSSVTMYYADFVKG

SEQ ID NO: 390 - DNA, 51 bp, Artificial Sequence
  source: /note="Description of Artificial Sequence: Synthetic heavy chain variable region CDR H2"
cacattagtagtagtagtgttaccatgtactacgcagactttgtgaagggc

SEQ ID NO: 391 - protein, 18 aa, Artificial Sequence
  source: /note="Description of Artificial Sequence: Synthetic heavy chain variable region CDR H3"
ARDAGPVWSGYYDYGMDV

SEQ ID NO: 392 - DNA, 54 bp, Artificial Sequence
  source: /note="Description of Artificial Sequence: Synthetic heavy chain variable region CDR H3"
gcgagagatgcgggaccagtttggagtggttattacgactacggtatggacgtc

SEQ ID NO: 393 - DNA, 324 bp, Artificial Sequence
  source: /note="Description of Artificial Sequence: Synthetic light chain variable region"
gaaacgacactcacgcagtctccagccacgctgtctttgtctccaggggaaagagccaccctctcctgcagggccagtcagagtgttagcagcctcttagcctggtaccaacagaaacctggccaggctcccaggctcctcatttttgatgcatccaagagggccactggcatcccagccaggttcagtggcagtgggtctgggacagacttcactctcaccatcagcagcctagagcctgaagattttgcagtctattactgtcagcagcgttacaactggcctccgctcactttcggcggagggaccaaggtggaaatcaaa

SEQ ID NO: 394 - protein, 108 aa, Artificial Sequence
  source: /note="Description of Artificial Sequence: Synthetic light chain variable region"
ETTLTQSPATLSLSPGERATLSCRASQSVSSLLAWYQQKPGQAPRLLIFDASKRATGIPARFSGSGSGTDFTLTISSLEPEDFAVYYCQQRYNWPPLTFGGGTKVEIK

SEQ ID NO: 395 - protein, 11 aa, Artificial Sequence
  source: /note="Description of Artificial Sequence: Synthetic light chain variable region CDR L1"
RASQSVSSLLA

SEQ ID NO: 396 - DNA, 33 bp, Artificial Sequence
  source: /note="Description of Artificial Sequence: Synthetic light chain variable region CDR L1"
agggccagtcagagtgttagcagcctcttagcc

SEQ ID NO: 397 - protein, 7 aa, Artificial Sequence
  source: /note="Description of Artificial Sequence: Synthetic light chain variable region CDR L2"
DASKRAT

SEQ ID NO: 398 - DNA, 21 bp, Artificial Sequence
  source: /note="Description of Artificial Sequence: Synthetic light chain variable region CDR L2"
gatgcatccaagagggccact

SEQ ID NO: 399 - protein, 10 aa, Artificial Sequence
  source: /note="Description of Artificial Sequence: Synthetic light chain variable region CDR L3"
QQRYNWPPLT

SEQ ID NO: 400 - DNA, 30 bp, Artificial Sequence
  source: /note="Description of Artificial Sequence: Synthetic light chain variable region CDR L3"
cagcagcgttacaactggcctccgctcact

SEQ ID NO: 401 - DNA, 366 bp, Artificial Sequence
  source: /note="Description of Artificial Sequence: Synthetic heavy chain variable region"
gaggtgcagctggtggagtctgggggaggcttggtccagcctggcaggtccctgagactctcctgtgcagcctttggattcacctttgatgattatgccatgcactgggtccggcaagctccagggaagggcctggagtgggtctcaggtattagttggaatagtggtttcataggctatgcggactctgtgaagggccgattcaccatctccagagacaatgccaagaactccctgtctctgcaaatgaacagtctgagaactgaggatacggccttgtattactgtgcaaaaactgatggagcagtggctgtcgacgggccctttgactactggggccagggaaccctggtcaccgtctcctca

SEQ ID NO: 402 - protein, 122 aa, Artificial Sequence
  source: /note="Description of Artificial Sequence: Synthetic heavy chain variable region"
EVQLVESGGGLVQPGRSLRLSCAAFGFTFDDYAMHWVRQAPGKGLEWVSGISWNSGFIGYADSVKGRFTISRDNAKNSLSLQMNSLRTEDTALYYCAKTDGAVAVDGPFDYWGQGTLVTVSS

SEQ ID NO: 403 - protein, 9 aa, Artificial Sequence
  source: /note="Description of Artificial Sequence: Synthetic heavy chain variable region CDR H1"
FTFDDYAMH

SEQ ID NO: 404 - DNA, 27 bp, Artificial Sequence
  source: /note="Description of Artificial Sequence: Synthetic heavy chain variable region CDR H1"
ttcacctttgatgattatgccatgcac

SEQ ID NO: 405 - protein, 17 aa, Artificial Sequence
  source: /note="Description of Artificial Sequence: Synthetic heavy chain variable region CDR H2"
GISWNSGFIGYADSVKG

SEQ ID NO: 406 - DNA, 51 bp, Artificial Sequence
  source: /note="Description of Artificial Sequence: Synthetic heavy chain variable region CDR H2"
ggtattagttggaatagtggtttcataggctatgcggactctgtgaagggc

SEQ ID NO: 407 - protein, 15 aa, Artificial Sequence
  source: /note="Description of Artificial Sequence: Synthetic heavy chain variable region CDR H3"
AKTDGAVAVDGPFDY

SEQ ID NO: 408 - DNA, 45 bp, Artificial Sequence
  source: /note="Description of Artificial Sequence: Synthetic heavy chain variable region CDR H3"
gcaaaaactgatggagcagtggctgtcgacgggccctttgactac

SEQ ID NO: 409 - DNA, 321 bp, Artificial Sequence
  source: /note="Description of Artificial Sequence: Synthetic light chain variable region"
gaaattgtgttgacacagtctccatcctccctgtctgcatctgtaggagacagagtcaccatcacttgccgggcaagtcagagcattagcggctatttaagttggtatcagcagaaaccagggaaagcccctaagctcctgatccattctacatctagtttgcaaagtggggtcccatcaaggttcagtggcagtggatctgggacagatttcactctcaccatcaccagtctgcaacctgaggattttgcaacttactactgtcaacagagttacattgcccctccgacttttggccaggggaccaaggtggaaatcaaa

SEQ ID NO: 410 - protein, 107 aa, Artificial Sequence
  source: /note="Description of Artificial Sequence: Synthetic light chain variable region"
EIVLTQSPSSLSASVGDRVTITCRASQSISGYLSWYQQKPGKAPKLLIHSTSSLQSGVPSRFSGSGSGTDFTLTITSLQPEDFATYYCQQSYIAPPTFGQGTKVEIK

SEQ ID NO: 411 - protein, 11 aa, Artificial Sequence
  source: /note="Description of Artificial Sequence: Synthetic light chain variable region CDR L1"
RASQSISGYLS

SEQ ID NO: 412 - DNA, 33 bp, Artificial Sequence
  source: /note="Description of Artificial Sequence: Synthetic light chain variable region CDR L1"
cgggcaagtcagagcattagcggctatttaagt

SEQ ID NO: 413 - protein, 7 aa, Artificial Sequence
  source: /note="Description of Artificial Sequence: Synthetic light chain variable region CDR L2"
STSSLQS

SEQ ID NO: 414 - DNA, 21 bp, Artificial Sequence
  source: /note="Description of Artificial Sequence: Synthetic light chain variable region CDR L2"
tctacatctagtttgcaaagt

SEQ ID NO: 415 - protein, 9 aa, Artificial Sequence
  source: /note="Description of Artificial Sequence: Synthetic light chain variable region CDR L3"
QQSYIAPPT

SEQ ID NO: 416 - DNA, 27 bp, Artificial Sequence
  source: /note="Description of Artificial Sequence: Synthetic light chain variable region CDR L3"
caacagagttacattgcccctccgact

SEQ ID NO: 417 - DNA, 348 bp, Artificial Sequence
  source: /note="Description of Artificial Sequence: Synthetic heavy chain variable region"
caggtccagctggtacagtctggggctgaggtgaagaagcctgggtcctcgatgaaggtctcctgccaggcttctggaggccccttcagcacctatactatcagctgggtgcgacaggcccctggacaagggcttgagtggatgggaggtatcatccctgtctttggtacaccaaactacgcgcagaagttccacggcagagtcacgattaccgcggaccaatccacgagcacagcctacatggagttgagtagcctgagatctgaggacaccgccgtttattactgtgcgggagccccctaccctatggacgtctggggccaagggaccacggtcaccgtctcctca

SEQ ID NO: 418 - protein, 116 aa, Artificial Sequence
  source: /note="Description of Artificial Sequence: Synthetic heavy chain variable region"
QVQLVQSGAEVKKPGSSMKVSCQASGGPFSTYTISWVRQAPGQGLEWMGGIIPVFGTPNYAQKFHGRVTITADQSTSTAYMELSSLRSEDTAVYYCAGAPYPMDVWGQGTTVTVSS

SEQ ID NO: 419 - protein, 9 aa, Artificial Sequence
  source: /note="Description of Artificial Sequence: Synthetic heavy chain variable region CDR H1"
GPFSTYTIS

SEQ ID NO: 420 - DNA, 27 bp, Artificial Sequence
  source: /note="Description of Artificial Sequence: Synthetic heavy chain variable region CDR H1"
ggccccttcagcacctatactatcagc

SEQ ID NO: 421 - protein, 17 aa, Artificial Sequence
  source: /note="Description of Artificial Sequence: Synthetic heavy chain variable region CDR H2"
GIIPVFGTPNYAQKFHG

SEQ ID NO: 422 - DNA, 51 bp, Artificial Sequence
  source: /note="Description of Artificial Sequence: Synthetic heavy chain variable region CDR H2"
ggtatcatccctgtctttggtacaccaaactacgcgcagaagttccacggc

SEQ ID NO: 423 - protein, 9 aa, Artificial Sequence
  source: /note="Description of Artificial Sequence: Synthetic heavy chain variable region CDR H3"
AGAPYPMDV

SEQ ID NO: 424 - DNA, 27 bp, Artificial Sequence
  source: /note="Description of Artificial Sequence: Synthetic heavy chain variable region CDR H3"
gcgggagccccctaccctatggacgtc

SEQ ID NO: 425 - DNA, 324 bp, Artificial Sequence
  source: /note="Description of Artificial Sequence: Synthetic light chain variable region"
gaaattgtattgacacagtctccagccaccctgtctttgtctccaggggagagagccaccctctcctgcagggccagtcagagtgttgccagctccttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtaccaactggcaggggctctctttcggcggagggaccaaagtggatatcaaa

SEQ ID NO: 426 - protein, 108 aa, Artificial Sequence
  source: /note="Description of Artificial Sequence: Synthetic light chain variable region"
EIVLTQSPATLSLSPGERATLSCRASQSVASSLAWYQQKPGQAPRLLIYDASNRATGIPARFSGSGSGTDFTLTISSLEPEDFAVYYCQQRTNWQGLSFGGGTKVDIK

SEQ ID NO: 427 - protein, 11 aa, Artificial Sequence
  source: /note="Description of Artificial Sequence: Synthetic light chain variable region CDR L1"
RASQSVASSLA

SEQ ID NO: 428 - DNA, 33 bp, Artificial Sequence
  source: /note="Description of Artificial Sequence: Synthetic light chain variable region CDR L1"
agggccagtcagagtgttgccagctccttagcc

SEQ ID NO: 429 - protein, 7 aa, Artificial Sequence
  source: /note="Description of Artificial Sequence: Synthetic light chain variable region CDR L2"
DASNRAT

SEQ ID NO: 430 - DNA, 21 bp, Artificial Sequence
  source: /note="Description of Artificial Sequence: Synthetic light chain variable region CDR L2"
gatgcatccaacagggccact

SEQ ID NO: 431 - protein, 10 aa, Artificial Sequence
  source: /note="Description of Artificial Sequence: Synthetic light chain variable region CDR L3"
QQRTNWQGLS

SEQ ID NO: 432 - DNA, 30 bp, Artificial Sequence
  source: /note="Description of Artificial Sequence: Synthetic light chain variable region CDR L3"
cagcagcgtaccaactggcaggggctctct

SEQ ID NO: 433 - DNA, 366 bp, Artificial Sequence
  source: /note="Description of Artificial Sequence: Synthetic heavy chain variable region"
caggtccagcttgtgcagtctggaggtgaggtcaagaagcctggggcctcagtgaaggtctcctgcaaggcttctggttacacctttatcagttatggtatcacctgggtgcgacaggcccctggacaagggcctgagtggatgggatggatcagcccttacaacggtgacacaaactatgcacagaagctccagggcagagtcaccatgaccacagacacatccacgaccacagcctacatggaactgaggagcctgagatctgacgacacggccatatattattgtgcgagacggtacgatattttgactggcgggggctggttcgactcctggggccagggaaccctggtcaccgtctcctca

SEQ ID NO: 434 - protein, 122 aa, Artificial Sequence
  source: /note="Description of Artificial Sequence: Synthetic heavy chain variable region"
QVQLVQSGGEVKKPGASVKVSCKASGYTFISYGITWVRQAPGQGPEWMGWISPYNGDTNYAQKLQGRVTMTTDTSTTTAYMELRSLRSDDTAIYYCARRYDILTGGGWFDSWGQGTLVTVSS

SEQ ID NO: 435 - protein, 9 aa, Artificial Sequence
  source: /note="Description of Artificial Sequence: Synthetic heavy chain variable region CDR H1"
YTFISYGIT

SEQ ID NO: 436 - DNA, 27 bp, Artificial Sequence
  source: /note="Description of Artificial Sequence: Synthetic heavy chain variable region CDR H1"
tacacctttatcagttatggtatcacc

SEQ ID NO: 437 - protein, 17 aa, Artificial Sequence
  source: /note="Description of Artificial Sequence: Synthetic heavy chain variable region CDR H2"
WISPYNGDTNYAQKLQG

SEQ ID NO: 438 - DNA, 51 bp, Artificial Sequence
  source: /note="Description of Artificial Sequence: Synthetic heavy chain variable region CDR H2"
tggatcagcccttacaacggtgacacaaactatgcacagaagctccagggc

SEQ ID NO: 439 - protein, 15 aa, Artificial Sequence
  source: /note="Description of Artificial Sequence: Synthetic heavy chain variable region CDR H3"
ARRYDILTGGGWFDS

SEQ ID NO: 440 - DNA, 45 bp, Artificial Sequence
  source: /note="Description of Artificial Sequence: Synthetic heavy chain variable region CDR H3"
gcgagacggtacgatattttgactggcgggggctggttcgactcc

SEQ ID NO: 441 - DNA, 321 bp, Artificial Sequence
  source: /note="Description of Artificial Sequence: Synthetic light chain variable region"
gatattgtgatgactcagtctccttcctccctgtctgcatctgtaggagacagagtcaccatcaattgccgggcaagtcagagcattatcagctatttaaattggtatcagcaaaaaccagggaaagcccctgagctcctaatctatgctgcgtccagtttgcaaagtggggtcccatcaaggttcagtggcagtggatctgggacagagttcactctcaccatcagcagtctgcaacctgaagattttgcaacgtactactgtcaacagagttacagtacccctcttagtttcggccctgggaccaaggtggagatcaaa

SEQ ID NO: 442 - protein, 107 aa, Artificial Sequence
  source: /note="Description of Artificial Sequence: Synthetic light chain variable region"
DIVMTQSPSSLSASVGDRVTINCRASQSIISYLNWYQQKPGKAPELLIYAASSLQSGVPSRFSGSGSGTEFTLTISSLQPEDFATYYCQQSYSTPLSFGPGTKVEIK

SEQ ID NO: 443 - protein, 11 aa, Artificial Sequence
  source: /note="Description of Artificial Sequence: Synthetic light chain variable region CDR L1"
RASQSIISYLN

SEQ ID NO: 444 - DNA, 33 bp, Artificial Sequence
  source: /note="Description of Artificial Sequence: Synthetic light chain variable region CDR L1"
cgggcaagtcagagcattatcagctatttaaat

SEQ ID NO: 445 - protein, 7 aa, Artificial Sequence
  source: /note="Description of Artificial Sequence: Synthetic light chain variable region CDR L2"
AASSLQS

SEQ ID NO: 446 - DNA, 21 bp, Artificial Sequence
  source: /note="Description of Artificial Sequence: Synthetic light chain variable region CDR L2"
gctgcgtccagtttgcaaagt

SEQ ID NO: 447 - protein, 9 aa, Artificial Sequence
  source: /note="Description of Artificial Sequence: Synthetic light chain variable region CDR L3"
QQSYSTPLS

SEQ ID NO: 448 - DNA, 27 bp, Artificial Sequence
  source: /note="Description of Artificial Sequence: Synthetic light chain variable region CDR L3"
caacagagttacagtacccctcttagt

SEQ ID NO: 449 - DNA, 369 bp, Artificial Sequence
  source: /note="Description of Artificial Sequence: Synthetic heavy chain variable region"
caggtccagcttgtgcagtctggagcagaggtgaaaaagcccggggagtctctgaagatctcctgtaagacttctggatacaaatttaccaattactggatcggctgggtgcgccagatgcccgggaaaggcctggagtggatggggatcatctatcctggtgactctgatgccagatacagcccgtccttccaaggccaggtcaccttctcagccgacaagtccatcagcaccgcctacctgcagtggagcagcctgaaggcctcggacaccgccatgtattactgtgcgagacaagataacagtggctgggccgacttctttccctttgactactggggccagggaaccctggtcaccgtctcctca

SEQ ID NO: 450 - protein, 123 aa, Artificial Sequence
  source: /note="Description of Artificial Sequence: Synthetic heavy chain variable region"
QVQLVQSGAEVKKPGESLKISCKTSGYKFTNYWIGWVRQMPGKGLEWMGIIYPGDSDARYSPSFQGQVTFSADKSISTAYLQWSSLKASDTAMYYCARQDNSGWADFFPFDYWGQGTLVTVSS

SEQ ID NO: 451 - protein, 9 aa, Artificial Sequence
  source: /note="Description of Artificial Sequence: Synthetic heavy chain variable region CDR H1"
YKFTNYWIG

SEQ ID NO: 452 - DNA, 27 bp, Artificial Sequence
  source: /note="Description of Artificial Sequence: Synthetic heavy chain variable region CDR H1"
tacaaatttaccaattactggatcggc

SEQ ID NO: 453 - protein, 17 aa, Artificial Sequence
  source: /note="Description of Artificial Sequence: Synthetic heavy chain variable region CDR H2"
IIYPGDSDARYSPSFQG

SEQ ID NO: 454 - DNA, 51 bp, Artificial Sequence
  source: /note="Description of Artificial Sequence: Synthetic heavy chain variable region CDR H2"
atcatctatcctggtgactctgatgccagatacagcccgtccttccaaggc

SEQ ID NO: 455 - protein, 16 aa, Artificial Sequence
  source: /note="Description of Artificial Sequence: Synthetic heavy chain variable region CDR H3"
ARQDNSGWADFFPFDY

SEQ ID NO: 456 - DNA, 48 bp, Artificial Sequence
  source: /note="Description of Artificial Sequence: Synthetic heavy chain variable region CDR H3"
gcgagacaagataacagtggctgggccgacttctttccctttgactac

SEQ ID NO: 457 - DNA, 324 bp, Artificial Sequence
  source: /note="Description of Artificial Sequence: Synthetic light chain variable region"
gaaacgacactcacgcagtctccaggcaccctgtctttgtctccaggggaaagagccaccctctcctgcagggccagtcacagttttagcagcagctacttagcctggtaccagcagaaacctggccaggctcccaggctcctcatctatgctgcatccaacagggccactggcatcccagacaggttcagtggcagtgggtctgggacagacttcactctcaccatcagcagactggagcctgaagattttgcagtgtatttctgtcagcagtatgatagctcaccgtggacgttcggccaagggaccaaggtggagatcaaa

SEQ ID NO: 458 - protein, 108 aa, Artificial Sequence
  source: /note="Description of Artificial Sequence: Synthetic light chain variable region"
ETTLTQSPGTLSLSPGERATLSCRASHSFSSSYLAWYQQKPGQAPRLLIYAASNRATGIPDRFSGSGSGTDFTLTISRLEPEDFAVYFCQQYDSSPWTFGQGTKVEIK

SEQ ID NO: 459 - protein, 12 aa, Artificial Sequence
  source: /note="Description of Artificial Sequence: Synthetic light chain variable region CDR L1"
RASHSFSSSYLA

SEQ ID NO: 460 - DNA, 36 bp, Artificial Sequence
  source: /note="Description of Artificial Sequence: Synthetic light chain variable region CDR L1"
agggccagtcacagttttagcagcagctacttagcc

SEQ ID NO: 461 - protein, 7 aa, Artificial Sequence
  source: /note="Description of Artificial Sequence: Synthetic light chain variable region CDR L2"
AASNRAT

SEQ ID NO: 462 - DNA, 21 bp, Artificial Sequence
  source: /note="Description of Artificial Sequence: Synthetic light chain variable region CDR L2"
gctgcatccaacagggccact

SEQ ID NO: 463 - protein, 9 aa, Artificial Sequence
  source: /note="Description of Artificial Sequence: Synthetic light chain variable region CDR L3"
QQYDSSPWT

SEQ ID NO: 464 - DNA, 27 bp, Artificial Sequence
  source: /note="Description of Artificial Sequence: Synthetic light chain variable region CDR L3"
cagcagtatgatagctcaccgtggacg

SEQ ID NO: 465 - DNA, 372 bp, Artificial Sequence
  source: /note="Description of Artificial Sequence: Synthetic heavy chain variable region"
gaggtgcagctggtggagtctgggggaggcgtggtccagcctgggaaatccctgagactctcctgtgccgcgtcgggattcatcttcagtggctatggcatgcactgggtccgccaggctccaggcaaggggctggagtgggtggcgtttatatggtttgatggaagttctacatattatgcagactccgtgaagggccgtttcaccatctccaaagacgattccaagcagacggtatatttgcaaatgaacaggctgagagccgaggacacggctgtctactactgtgcgagagaccccttatttttatacaattataatgacgaaccttttgactactggggacagggaaccctggtcaccgtctcctca

SEQ ID NO: 466 - protein, 124 aa, Artificial Sequence
  source: /note="Description of Artificial Sequence: Synthetic heavy chain variable region"
EVQLVESGGGVVQPGKSLRLSCAASGFIFSGYGMHWVRQAPGKGLEWVAFIWFDGSSTYYADSVKGRFTISKDDSKQTVYLQMNRLRAEDTAVYYCARDPLFLYNYNDEPFDYWGQGTLVTVSS

SEQ ID NO: 467 - protein, 9 aa, Artificial Sequence
  source: /note="Description of Artificial Sequence: Synthetic heavy chain variable region CDR H1"
FIFSGYGMH

SEQ ID NO: 468 - DNA, 27 bp, Artificial Sequence
  source: /note="Description of Artificial Sequence: Synthetic heavy chain variable region CDR H1"
ttcatcttcagtggctatggcatgcac

SEQ ID NO: 469 - protein, 17 aa, Artificial Sequence
  source: /note="Description of Artificial Sequence: Synthetic heavy chain variable region CDR H2"
FIWFDGSSTYYADSVKG

SEQ ID NO: 470 - DNA, 51 bp, Artificial Sequence
  source: /note="Description of Artificial Sequence: Synthetic heavy chain variable region CDR H2"
tttatatggtttgatggaagttctacatattatgcagactccgtgaagggc

SEQ ID NO: 471 - protein, 17 aa, Artificial Sequence
  source: /note="Description of Artificial Sequence: Synthetic heavy chain variable region CDR H3"
ARDPLFLYNYNDEPFDY

SEQ ID NO: 472 - DNA, 51 bp, Artificial Sequence
  source: /note="Description of Artificial Sequence: Synthetic heavy chain variable region CDR H3"
gcgagagaccccttatttttatacaattataatgacgaaccttttgactac

SEQ ID NO: 473 - DNA, 330 bp, Artificial Sequence
  source: /note="Description of Artificial Sequence: Synthetic light chain variable region"
tcctatgagctgacacagccaccctcagcgtctggttcccccgggcagagcgtcaccatctcttgttctggaagcagctccaatatcgggggtaattttgtgtactggtaccagcaactgcccggaacggcccccaaagtcctcatctataggaataatcagcggccctcaggggtccctgaccgattctctggctccaagtctggcacttcagcctccctggccatcagtgggctccggtccgacgatgaggctgattattattgttcagtatgggatgacagcctaaatggtcggctgttcggcggagggaccaagctgaccgtccta

SEQ ID NO: 474 - protein, 110 aa, Artificial Sequence
  source: /note="Description of Artificial Sequence: Synthetic light chain variable region"
SYELTQPPSASGSPGQSVTISCSGSSSNIGGNFVYWYQQLPGTAPKVLIYRNNQRPSGVPDRFSGSKSGTSASLAISGLRSDDEADYYCSVWDDSLNGRLFGGGTKLTVL

SEQ ID NO: 475 - protein, 13 aa, Artificial Sequence
  source: /note="Description of Artificial Sequence: Synthetic light chain variable region CDR L1"
SGSSSNIGGNFVY

SEQ ID NO: 476 - DNA, 39 bp, Artificial Sequence
  source: /note="Description of Artificial Sequence: Synthetic light chain variable region CDR L1"
tctggaagcagctccaatatcgggggtaattttgtgtac

SEQ ID NO: 477 - protein, 7 aa, Artificial Sequence
  source: /note="Description of Artificial Sequence: Synthetic light chain variable region CDR L2"
RNNQRPS

SEQ ID NO: 478 - DNA, 21 bp, Artificial Sequence
  source: /note="Description of Artificial Sequence: Synthetic light chain variable region CDR L2"
aggaataatcagcggccctca

SEQ ID NO: 479 - protein, 11 aa, Artificial Sequence
  source: /note="Description of Artificial Sequence: Synthetic light chain variable region CDR L3"
SVWDDSLNGRL

SEQ ID NO: 480 - DNA, 33 bp, Artificial Sequence
  source: /note="Description of Artificial Sequence: Synthetic light chain variable region CDR L3"
tcagtatgggatgacagcctaaatggtcggctg

SEQ ID NO: 481 - DNA, 369 bp, Artificial Sequence
  source: /note="Description of Artificial Sequence: Synthetic heavy chain variable region"
gaggtgcagctggtggagtctgggggaggtgtggtccggcctggggggtccctgagactctcctgtgcagcctctggattcaagtttgatgattatggcatgagctgggtccgccaagctccagggaaggggctggagtgggtctctgcaattatttggaatagtggtagcacaggttatgcagactctgtgaagggccgattcatcatctccagagacaacgccaagaactccctgtatctgcaaatgaatagtctgagagccgaagacacggccttgtattactgtgcgagagtcggggggataacgaagtggtggtactacggtatggacctctggggccaagggaccacggtcaccgtctcctca

SEQ ID NO: 482 - protein, 123 aa, Artificial Sequence
  source: /note="Description of Artificial Sequence: Synthetic heavy chain variable region"
EVQLVESGGGVVRPGGSLRLSCAASGFKFDDYGMSWVRQAPGKGLEWVSAIIWNSGSTGYADSVKGRFIISRDNAKNSLYLQMNSLRAEDTALYYCARVGGITKWWYYGMDLWGQGTTVTVSS

SEQ ID NO: 483 - protein, 9 aa, Artificial Sequence
  source: /note="Description of Artificial Sequence: Synthetic heavy chain variable region CDR H1"
FKFDDYGMS

SEQ ID NO: 484 - DNA, 27 bp, Artificial Sequence
  source: /note="Description of Artificial Sequence: Synthetic heavy chain variable region CDR H1"
ttcaagtttgatgattatggcatgagc

SEQ ID NO: 485 - protein, 17 aa, Artificial Sequence
  source: /note="Description of Artificial Sequence: Synthetic heavy chain variable region CDR H2"
AIIWNSGSTGYADSVKG

SEQ ID NO: 486 - DNA, 51 bp, Artificial Sequence
  source: /note="Description of Artificial Sequence: Synthetic heavy chain variable region CDR H2"
gcaattatttggaatagtggtagcacaggttatgcagactctgtgaagggc

SEQ ID NO: 487 - protein, 16 aa, Artificial Sequence
  source: /note="Description of Artificial Sequence: Synthetic heavy chain variable region CDR H3"
ARVGGITKWWYYGMDL

SEQ ID NO: 488 - DNA, 48 bp, Artificial Sequence
  source: /note="Description of Artificial Sequence: Synthetic heavy chain variable region CDR H3"
gcgagagtcggggggataacgaagtggtggtactacggtatggacctc

SEQ ID NO: 489 - DNA, 321 bp, Artificial Sequence
  source: /note="Description of Artificial Sequence: Synthetic light chain variable region"
gaaacgacactcacgcagtctccatccttcctgtctgcatctgtcggagacagagtcaccatcacttgccgggccagtcagggcttgagcaattatttagcctggtatcagcaaaaaccagggagagcccccaagctcctgatctatgctgcatccactttgcaaagtggggtcccatcaaggttcagaggcagtggatctgggacagagttcactctcacaatcagcagcctgcagcctgaagatcttgcaacttattactgtcaacaccttaatagttaccctctcactttcggcggagggaccaaggtggagatcaaa

SEQ ID NO: 490 - protein, 107 aa, Artificial Sequence
  source: /note="Description of Artificial Sequence: Synthetic light chain variable region"
ETTLTQSPSFLSASVGDRVTITCRASQGLSNYLAWYQQKPGRAPKLLIYAASTLQSGVPSRFRGSGSGTEFTLTISSLQPEDLATYYCQHLNSYPLTFGGGTKVEIK

SEQ ID NO: 491 - protein, 11 aa, Artificial Sequence
  source: /note="Description of Artificial Sequence: Synthetic light chain variable region CDR L1"
RASQGLSNYLA

SEQ ID NO: 492 - DNA, 33 bp, Artificial Sequence
  source: /note="Description of Artificial Sequence: Synthetic light chain variable region CDR L1"
cgggccagtcagggcttgagcaattatttagcc

SEQ ID NO: 493 - protein, 7 aa, Artificial Sequence
  source: /note="Description of Artificial Sequence: Synthetic light chain variable region CDR L2"
AASTLQS

SEQ ID NO: 494 - DNA, 21 bp, Artificial Sequence
  source: /note="Description of Artificial Sequence: Synthetic light chain variable region CDR L2"
gctgcatccactttgcaaagt

SEQ ID NO: 495 - protein, 9 aa, Artificial Sequence
  source: /note="Description of Artificial Sequence: Synthetic light chain variable region CDR L3"
QHLNSYPLT

SEQ ID NO: 496 - DNA, 27 bp, Artificial Sequence
  source: /note="Description of Artificial Sequence: Synthetic light chain variable region CDR L3"
caacaccttaatagttaccctctcact

SEQ ID NO: 497 - DNA, 372 bp, Artificial Sequence
  source: /note="Description of Artificial Sequence: Synthetic heavy chain variable region"
gaggtgcagctggtggagtcgggccccggactggtgaagccttcggagaccctgtccctcatctgcagagtctttggtgggtccgtcaggaggggggactacaactggaattggatccggcagcccccagggaagggactggagtggattggctatatcgattatagtgggaccaccaagtacaatccctccctcaagagccgagtgaccatatcagaagacacgtccaggaatcagttctccctggagctgaggtctgtgaccgccgcggacacggccatgtattactgtgcgagagacgttggaagtactccctacaactattacggtatggacgtctggggccaagggaccacggtcaccgtctcctca

SEQ ID NO: 498 - protein, 124 aa, Artificial Sequence
  source: /note="Description of Artificial Sequence: Synthetic heavy chain variable region"
EVQLVESGPGLVKPSETLSLICRVFGGSVRRGDYNWNWIRQPPGKGLEWIGYIDYSGTTKYNPSLKSRVTISEDTSRNQFSLELRSVTAADTAMYYCARDVGSTPYNYYGMDVWGQGTTVTVSS

SEQ ID NO: 499 - protein, 11 aa, Artificial Sequence
  source: /note="Description of Artificial Sequence: Synthetic heavy chain variable region CDR H1"
GSVRRGDYNWN

SEQ ID NO: 500 - DNA, 33 bp, Artificial Sequence
  source: /note="Description of Artificial Sequence: Synthetic heavy chain variable region CDR H1"
gggtccgtcaggaggggggactacaactggaat

SEQ ID NO: 501 - protein, 16 aa, Artificial Sequence
  source: /note="Description of Artificial Sequence: Synthetic heavy chain variable region CDR H2"
YIDYSGTTKYNPSLKS

SEQ ID NO: 502 - DNA, 48 bp, Artificial Sequence
  source: /note="Description of Artificial Sequence: Synthetic heavy chain variable region CDR H2"
tatatcgattatagtgggaccaccaagtacaatccctccctcaagagc

SEQ ID NO: 503 - protein, 16 aa, Artificial Sequence
  source: /note="Description of Artificial Sequence: Synthetic heavy chain variable region CDR H3"
ARDVGSTPYNYYGMDV

SEQ ID NO: 504 - DNA, 48 bp, Artificial Sequence
  source: /note="Description of Artificial Sequence: Synthetic heavy chain variable region CDR H3"
gcgagagacgttggaagtactccctacaactattacggtatggacgtc

SEQ ID NO: 505 - DNA, 327 bp, Artificial Sequence
  source: /note="Description of Artificial Sequence: Synthetic light chain variable region"
gaaattgtgttgacgcagtctccaggcaccctgtccttgtctccaggggaaagagccaccctctcctgtagggccagtcagactattaaaaacaactacttagcctggtaccaacagaaacctggccaggctcccaggctcctcatgtatggtgtatccagcaggccgactggcatcccagacaggttcagtggcagtgggtctgggacagacttcagtctcaccatcgacagactggagcctgaagattttgcagtatattactgtcagcagtttggtaggtcaccggagctcactttcggcggagggaccaaggtggaaatcaaa

SEQ ID NO: 506 - protein, 109 aa, Artificial Sequence
  source: /note="Description of Artificial Sequence: Synthetic light chain variable region"
EIVLTQSPGTLSLSPGERATLSCRASQTIKNNYLAWYQQKPGQAPRLLMYGVSSRPTGIPDRFSGSGSGTDFSLTIDRLEPEDFAVYYCQQFGRSPELTFGGGTKVEIK

SEQ ID NO: 507 - protein, 12 aa, Artificial Sequence
  source: /note="Description of Artificial Sequence: Synthetic light chain variable region CDR L1"
RASQTIKNNYLA

SEQ ID NO: 508 - DNA, 36 bp, Artificial Sequence
  source: /note="Description of Artificial Sequence: Synthetic light chain variable region CDR L1"
agggccagtcagactattaaaaacaactacttagcc

SEQ ID NO: 509 - protein, 7 aa, Artificial Sequence
  source: /note="Description of Artificial Sequence: Synthetic light chain variable region CDR L2"
GVSSRPT

SEQ ID NO: 510 - DNA, 21 bp, Artificial Sequence
  source: /note="Description of Artificial Sequence: Synthetic light chain variable region CDR L2"
ggtgtatccagcaggccgact

SEQ ID NO: 511 - protein, 10 aa, Artificial Sequence
  source: /note="Description of Artificial Sequence: Synthetic light chain variable region CDR L3"
QQFGRSPELT

SEQ ID NO: 512 - DNA, 30 bp, Artificial Sequence
  source: /note="Description of Artificial Sequence: Synthetic light chain variable region CDR L3"
cagcagtttggtaggtcaccggagctcact

SEQ ID NO: 513 - DNA, 354 bp, Artificial Sequence
  source: /note="Description of Artificial Sequence: Synthetic heavy chain variable region"
caggtgcagctacagcagtggggcgcaggactgttgaagccttcggagaccctgtccctcacctgcgctgtctatggtgggtccttcagtggttactactggggctggatccgccagcccccagggaaggggctggagtggattggggaagtcaatcatagtggaacctccaattacaacccgtccctcacgagtcgagtcaccatatcagtagacccgtccaagaaacagttgtccctgaagctgaactctgtgaccgccgcggacacggctgtctattactgtgcgagagctccttggtatactcacgccatggacgtctggggccaagggaccacggtcaccgtctcctca

SEQ ID NO: 514 - protein, 118 aa, Artificial Sequence
  source: /note="Description of Artificial Sequence: Synthetic heavy chain variable region"
QVQLQQWGAGLLKPSETLSLTCAVYGGSFSGYYWGWIRQPPGKGLEWIGEVNHSGTSNYNPSLTSRVTISVDPSKKQLSLKLNSVTAADTAVYYCARAPWYTHAMDVWGQGTTVTVSS

SEQ ID NO: 515 - protein, 9 aa, Artificial Sequence
  source: /note="Description of Artificial Sequence: Synthetic heavy chain variable region CDR H1"
GSFSGYYWG

SEQ ID NO: 516 - DNA, 27 bp, Artificial Sequence
  source: /note="Description of Artificial Sequence: Synthetic heavy chain variable region CDR H1"
gggtccttcagtggttactactggggc

SEQ ID NO: 517 - protein, 16 aa, Artificial Sequence
  source: /note="Description of Artificial Sequence: Synthetic heavy chain variable region CDR H2"
EVNHSGTSNYNPSLTS

SEQ ID NO: 518 - DNA, 48 bp, Artificial Sequence
  source: /note="Description of Artificial Sequence: Synthetic heavy chain variable region CDR H2"
gaagtcaatcatagtggaacctccaattacaacccgtccctcacgagt

SEQ ID NO: 519 - protein, 12 aa, Artificial Sequence
  source: /note="Description of Artificial Sequence: Synthetic heavy chain variable region CDR H3"
ARAPWYTHAMDV

SEQ ID NO: 520 - DNA, 36 bp, Artificial Sequence
  source: /note="Description of Artificial Sequence: Synthetic heavy chain variable region CDR H3"
gcgagagctccttggtatactcacgccatggacgtc

SEQ ID NO: 521 - DNA, 333 bp, Artificial Sequence
  source: /note="Description of Artificial Sequence: Synthetic light chain variable region"
cagtctgtcctgactcagcctgcctccgtgtctgggtctcctggacagtcgatcaccatctcctgcactagaaccagcagtgacgttggtgcttatagttatgtctcctggtaccaacaacacccaggcaaagcccccaaactcatgatttatgatgtcaataatcggccctcaggggtttctaatcgcttctctggctccaagtctggcaacacggcctccctgaccatctctgggctccaggctgaggacgaggctgattattactgcagctcatatacaaacagcaacactctcggggtgttcggcggagggaccaagctgaccgtccta

SEQ ID NO: 522 - protein, 111 aa, Artificial Sequence
  source: /note="Description of Artificial Sequence: Synthetic light chain variable region"
QSVLTQPASVSGSPGQSITISCTRTSSDVGAYSYVSWYQQHPGKAPKLMIYDVNNRPSGVSNRFSGSKSGNTASLTISGLQAEDEADYYCSSYTNSNTLGVFGGGTKLTVL

SEQ ID NO: 523 - protein, 14 aa, Artificial Sequence
  source: /note="Description of Artificial Sequence: Synthetic light chain variable region CDR L1"
TRTSSDVGAYSYVS

SEQ ID NO: 524 - DNA, 42 bp, Artificial Sequence
  source: /note="Description of Artificial Sequence: Synthetic light chain variable region CDR L1"
actagaaccagcagtgacgttggtgcttatagttatgtctcc

SEQ ID NO: 525 - protein, 7 aa, Artificial Sequence
  source: /note="Description of Artificial Sequence: Synthetic light chain variable region CDR L2"
DVNNRPS

SEQ ID NO: 526 - DNA, 21 bp, Artificial Sequence
  source: /note="Description of Artificial Sequence: Synthetic light chain variable region CDR L2"
gatgtcaataatcggccctca

SEQ ID NO: 527 - protein, 11 aa, Artificial Sequence
  source: /note="Description of Artificial Sequence: Synthetic light chain variable region CDR L3"
SSYTNSNTLGV

SEQ ID NO: 528 - DNA, 33 bp, Artificial Sequence
  source: /note="Description of Artificial Sequence: Synthetic light chain variable region CDR L3"
agctcatatacaaacagcaacactctcggggtg

SEQ ID NO: 529 - DNA, 363 bp, Artificial Sequence
  source: /note="Description of Artificial Sequence: Synthetic heavy chain variable region"
gaggtgcagctgttggagtctgggggactcgtggtacagcctggggggtccctgagactgtcctgtgcagcctctggattcatctttgatgattataccatgcactgggtccgtcaagctccggggaagggtctggagtggatctctcttattagttgggatagtcttgacacatactatgcaggctctgtgcagggccgcttcaccatctccagagacaacagcagaaactccctctatctgcgaatgaacagtctgagacctgaggacaccgccttgtattactgtgcaaaaacaaagtataggggtacttattactactttgactcgtggggccagggaaccctggtcaccgtctcctca

SEQ ID NO: 530 - protein, 121 aa, Artificial Sequence
  source: /note="Description of Artificial Sequence: Synthetic heavy chain variable region"
EVQLLESGGLVVQPGGSLRLSCAASGFIFDDYTMHWVRQAPGKGLEWISLISWDSLDTYYAGSVQGRFTISRDNSRNSLYLRMNSLRPEDTALYYCAKTKYRGTYYYFDSWGQGTLVTVSS

SEQ ID NO: 531 - protein, 9 aa, Artificial Sequence
  source: /note="Description of Artificial Sequence: Synthetic heavy chain variable region CDR H1"
FIFDDYTMH

SEQ ID NO: 532 - DNA, 27 bp, Artificial Sequence
  source: /note="Description of Artificial Sequence: Synthetic heavy chain variable region CDR H1"
ttcatctttgatgattataccatgcac

SEQ ID NO: 533 - protein, 17 aa, Artificial Sequence
  source: /note="Description of Artificial Sequence: Synthetic heavy chain variable region CDR H2"
LISWDSLDTYYAGSVQG

SEQ ID NO: 534 - DNA, 51 bp, Artificial Sequence
  source: /note="Description of Artificial Sequence: Synthetic heavy chain variable region CDR H2"
cttattagttgggatagtcttgacacatactatgcaggctctgtgcagggc

SEQ ID NO: 535 - protein, 14 aa, Artificial Sequence
  source: /note="Description of Artificial Sequence: Synthetic heavy chain variable region CDR H3"
AKTKYRGTYYYFDS

SEQ ID NO: 536 - DNA, 42 bp, Artificial Sequence
  source: /note="Description of Artificial Sequence: Synthetic heavy chain variable region CDR H3"
gcaaaaacaaagtataggggtacttattactactttgactcg

SEQ ID NO: 537 - DNA, 324 bp, Artificial Sequence
  source: /note="Description of Artificial Sequence: Synthetic light chain variable region"
gacatccgggtgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggacgtggatctgggacagattttactttcaccatcagcagcctgcagcctgaagatattgcaacatattactgtcaacaatatgataatctccctccggtcactttcggccctgggaccaaggtggaaatcaaa

SEQ ID NO: 538 - protein, 108 aa, Artificial Sequence
  source: /note="Description of Artificial Sequence: Synthetic light chain variable region"
DIRVTQSPSSLSASVGDRVTITCQASQDISNYLNWYQQKPGKAPKLLIYDASNLETGVPSRFSGRGSGTDFTFTISSLQPEDIATYYCQQYDNLPPVTFGPGTKVEIK

SEQ ID NO: 539 - protein, 11 aa, Artificial Sequence
  source: /note="Description of Artificial Sequence: Synthetic light chain variable region CDR L1"
QASQDISNYLN

SEQ ID NO: 540 - DNA, 33 bp, Artificial Sequence
  source: /note="Description of Artificial Sequence: Synthetic light chain variable region CDR L1"
caggcgagtcaggacattagcaactatttaaat

SEQ ID NO: 541 - protein, 7 aa, Artificial Sequence
  source: /note="Description of Artificial Sequence: Synthetic light chain variable region CDR L2"
DASNLET

SEQ ID NO: 542 - DNA, 21 bp, Artificial Sequence
  source: /note="Description of Artificial Sequence: Synthetic light chain variable region CDR L2"
gatgcatccaatttggaaaca

SEQ ID NO: 543 - protein, 10 aa, Artificial Sequence
  source: /note="Description of Artificial Sequence: Synthetic light chain variable region CDR L3"
QQYDNLPPVT

SEQ ID NO: 544 - DNA, 30 bp, Artificial Sequence
  source: /note="Description of Artificial Sequence: Synthetic light chain variable region CDR L3"
caacaatatgataatctccctccggtcact

SEQ ID NO: 545 - DNA, 372 bp, Artificial Sequence
  source: /note="Description of Artificial Sequence: Synthetic heavy chain variable region"
gaggtgcagctgttggagtctgggggaggcctggtcaagccgggggggtccctgagactctcctgtgcagcctctggattcaccttcagtagttatggcatgcactgggtccgccaggcgccagggaaggggctagagtgggtctcatccattactgctggtagtagttacatggactacgcagactcagtgaagggccgattcaccgtctccagagacaacggcaagaactcactgtacctgcaaatgaacagcctgagagccgaggacacggctgtctacttctgtgcgagagaggactatgatagtcgtgtttattaccttaagtggttcgacccctggggccagggaaccctggtcaccgtctcctca

SEQ ID NO: 546 - protein, 124 aa, Artificial Sequence
  source: /note="Description of Artificial Sequence: Synthetic heavy chain variable region"
EVQLLESGGGLVKPGGSLRLSCAASGFTFSSYGMHWVRQAPGKGLEWVSSITAGSSYMDYADSVKGRFTVSRDNGKNSLYLQMNSLRAEDTAVYFCAREDYDSRVYYLKWFDPWGQGTLVTVSS

SEQ ID NO: 547 - protein, 9 aa, Artificial Sequence
  source: /note="Description of Artificial Sequence: Synthetic heavy chain variable region CDR H1"
FTFSSYGMH

SEQ ID NO: 548 - DNA, 27 bp, Artificial Sequence
  source: /note="Description of Artificial Sequence: Synthetic heavy chain variable region CDR H1"
ttcaccttcagtagttatggcatgcac

SEQ ID NO: 549 - protein, 17 aa, Artificial Sequence
  source: /note="Description of Artificial Sequence: Synthetic heavy chain variable region CDR H2"
SITAGSSYMDYADSVKG

SEQ ID NO: 550 - DNA, 51 bp, Artificial Sequence
  source: /note="Description of Artificial Sequence: Synthetic heavy chain variable region CDR H2"
tccattactgctggtagtagttacatggactacgcagactcagtgaagggc

SEQ ID NO: 551 - protein, 17 aa, Artificial Sequence
  source: /note="Description of Artificial Sequence: Synthetic heavy chain variable region CDR H3"
AREDYDSRVYYLKWFDP

SEQ ID NO: 552 - DNA, 51 bp, Artificial Sequence
  source: /note="Description of Artificial Sequence: Synthetic heavy chain variable region CDR H3"
gcgagagaggactatgatagtcgtgtttattaccttaagtggttcgacccc

SEQ ID NO: 553 - DNA, 333 bp, Artificial Sequence
  source: /note="Description of Artificial Sequence: Synthetic light chain variable region"
cagtctgtcttgacgcagccgccctcagtgtctggggccccagggcagagagtcaccatctcctgcactgggagcagctccaacatcgggacaggttatgatgtacactggtaccagcagcttccaggatcagcccccaaactcctcatctatggtaacagcaatcggccctcaggggtccctgaccgattctctgggtccaagtctggcacctcagcctccctggccatcactgggctccaggctgaggatgaggctgactattattgccagtcctatgacagcagtcggagtggttatgtcttcggaactgggaccaagctgaccgtccta

SEQ ID NO: 554 - protein, 111 aa, Artificial Sequence
  source: /note="Description of Artificial Sequence: Synthetic light chain variable region"
QSVLTQPPSVSGAPGQRVTISCTGSSSNIGTGYDVHWYQQLPGSAPKLLIYGNSNRPSGVPDRFSGSKSGTSASLAITGLQAEDEADYYCQSYDSSRSGYVFGTGTKLTVL

SEQ ID NO: 555 - protein, 14 aa, Artificial Sequence
  source: /note="Description of Artificial Sequence: Synthetic light chain variable region CDR L1"
TGSSSNIGTGYDVH

SEQ ID NO: 556 - DNA, 42 bp, Artificial Sequence
  source: /note="Description of Artificial Sequence: Synthetic light chain variable region CDR L1"
actgggagcagctccaacatcgggacaggttatgatgtacac

SEQ ID NO: 557 - protein, 7 aa, Artificial Sequence
  source: /note="Description of Artificial Sequence: Synthetic light chain variable region CDR L2"
GNSNRPS

SEQ ID NO: 558 - DNA, 21 bp, Artificial Sequence
  source: /note="Description of Artificial Sequence: Synthetic light chain variable region CDR L2"
ggtaacagcaatcggccctca

SEQ ID NO: 559 - protein, 11 aa, Artificial Sequence
  source: /note="Description of Artificial Sequence: Synthetic light chain variable region CDR L3"
QSYDSSRSGYV

SEQ ID NO: 560 - DNA, 33 bp, Artificial Sequence
  source: /note="Description of Artificial Sequence: Synthetic light chain variable region CDR L3"
cagtcctatgacagcagtcggagtggttatgtc

SEQ ID NO: 561 - DNA, 369 bp, Artificial Sequence
  source: /note="Description of Artificial Sequence: Synthetic heavy chain variable region"
gaggtgcagctggtggagtctgggggcgccttggtaaagccgggggggtcccttagactctcctgtgtaggcactggactcactttcactactgcctacatgagctgggcccgccaggctccagggaaggggctggagtgggttggtcgcattaagagcaaaagtgatggtgggacaacagagtaccctacacccgtcaaaggcagattcaccatctcaagagatgaatccaaaaacaccctgtatctgcaaatgaacagcctgaaaatcgaggacacagccgtctattattgtaccacagatagggggataacagctcgtcctatcttcgactcctggggccagggaaccctggtcaccgtctcctca

SEQ ID NO: 562 - protein, 123 aa, Artificial Sequence
  source: /note="Description of Artificial Sequence: Synthetic heavy chain variable region"
EVQLVESGGALVKPGGSLRLSCVGTGLTFTTAYMSWARQAPGKGLEWVGRIKSKSDGGTTEYPTPVKGRFTISRDESKNTLYLQMNSLKIEDTAVYYCTTDRGITARPIFDSWGQGTLVTVSS

SEQ ID NO: 563 - protein, 9 aa, Artificial Sequence
  source: /note="Description of Artificial Sequence: Synthetic heavy chain variable region CDR H1"
LTFTTAYMS

SEQ ID NO: 564 - DNA, 27 bp, Artificial Sequence
  source: /note="Description of Artificial Sequence: Synthetic heavy chain variable region CDR H1"
ctcactttcactactgcctacatgagc

SEQ ID NO: 565 - protein, 19 aa, Artificial Sequence
  source: /note="Description of Artificial Sequence: Synthetic heavy chain variable region CDR H2"
RIKSKSDGGTTEYPTPVKG

SEQ ID NO: 566 - DNA, 57 bp, Artificial Sequence
  source: /note="Description of Artificial Sequence: Synthetic heavy chain variable region CDR H2"
cgcattaagagcaaaagtgatggtgggacaacagagtaccctacacccgtcaaaggc

SEQ ID NO: 567 - protein, 14 aa, Artificial Sequence
  source: /note="Description of Artificial Sequence: Synthetic heavy chain variable region CDR H3"
TTDRGITARPIFDS

SEQ ID NO: 568 - DNA, 42 bp, Artificial Sequence; identical to SEQ ID NO: 40
  source: /note="Description of Artificial Sequence: Synthetic heavy chain variable region CDR H3"

SEQ ID NO: 569 - DNA, 333 bp, Artificial Sequence
  source: /note="Description of Artificial Sequence: Synthetic light chain variable region"
cagtctgtcttgacgcagccgccctcagtgtctggggccctagggcggagggtcaccatctcctgcactgggagcagctccaacatcggggcaggttatgatgtacattggtacaggcaacttccaggaacagcccccaaactcctcatttatggtaacaccaaacggccctcaggggtccctgaccgattctctggctccaagtatgccacctcagcctccctggccatcactgggctccaggctgaggatgacgctgattattactgccagtcctatgacggcggcctgagtggttatgtcttcggaactggcacccagctgaccgtcctc

SEQ ID NO: 570 - protein, 111 aa, Artificial Sequence
  source: /note="Description of Artificial Sequence: Synthetic light chain variable region"
QSVLTQPPSVSGALGRRVTISCTGSSSNIGAGYDVHWYRQLPGTAPKLLIYGNTKRPSGVPDRFSGSKYATSASLAITGLQAEDDADYYCQSYDGGLSGYVFGTGTQLTVL

SEQ ID NO: 571 - protein, 14 aa, Artificial Sequence
  source: /note="Description of Artificial Sequence: Synthetic light chain variable region CDR L1"
TGSSSNIGAGYDVH

SEQ ID NO: 572 - DNA, 42 bp, Artificial Sequence
  source: /note="Description of Artificial Sequence: Synthetic light chain variable region CDR L1"
actgggagcagctccaacatcggggcaggttatgatgtacat

SEQ ID NO: 573 - protein, 7 aa, Artificial Sequence
  source: /note="Description of Artificial Sequence: Synthetic light chain variable region CDR L2"
GNTKRPS

SEQ ID NO: 574 - DNA, 21 bp, Artificial Sequence
  source: /note="Description of Artificial Sequence: Synthetic light chain variable region CDR L2"
ggtaacaccaaacggccctca

SEQ ID NO: 575 - protein, 11 aa, Artificial Sequence
  source: /note="Description of Artificial Sequence: Synthetic light chain variable region CDR L3"
QSYDGGLSGYV

SEQ ID NO: 576 - DNA, 33 bp, Artificial Sequence; identical to SEQ ID NO: 48
  source: /note="Description of Artificial Sequence: Synthetic light chain variable region CDR L3"

SEQ ID NO: 577 - DNA, 381 bp, Artificial Sequence
  source: /note="Description of Artificial Sequence: Synthetic heavy chain variable region"
caggtccagcttgtgcagtctgggggaggcctggtcaggcctggggggtccctgagactctcctgtgcagcctctggattcatgttcagtacctacagcatgaactggctccgcacggtcccagggaaggggctggagtgggtctcatccattagtggtagtagcagtcacatatactacgcagactcagtgaagggccgattcaccatctccagagacaacaccaagaactcactgtatctgcaaatgaacagcctgagacccgaagacacggctttatattactgtgcgagatattttggtgactactcagggttggggaactactactactacggtatggacgtctggggccaggggaccacggtcaccgtctcctca

SEQ ID NO: 578 - protein, 127 aa, Artificial Sequence
  source: /note="Description of Artificial Sequence: Synthetic heavy chain variable region"
QVQLVQSGGGLVRPGGSLRLSCAASGFMFSTYSMNWLRTVPGKGLEWVSSISGSSSHIYYADSVKGRFTISRDNTKNSLYLQMNSLRPEDTALYYCARYFGDYSGLGNYYYYGMDVWGQGTTVTVSS

SEQ ID NO: 579 - protein, 9 aa, Artificial Sequence
  source: /note="Description of Artificial Sequence: Synthetic heavy chain variable region CDR H1"
FMFSTYSMN

SEQ ID NO: 580 - DNA, 27 bp, Artificial Sequence
  source: /note="Description of Artificial Sequence: Synthetic heavy chain variable region CDR H1"
ttcatgttcagtacctacagcatgaac

SEQ ID NO: 581 - protein, 17 aa, Artificial Sequence
  source: /note="Description of Artificial Sequence: Synthetic heavy chain variable region CDR H2"
SISGSSSHIYYADSVKG

SEQ ID NO: 582 - DNA, 51 bp, Artificial Sequence
  source: /note="Description of Artificial Sequence: Synthetic heavy chain variable region CDR H2"
tccattagtggtagtagcagtcacatatactacgcagactcagtgaagggc

SEQ ID NO: 583 - protein, 20 aa, Artificial Sequence
  source: /note="Description of Artificial Sequence: Synthetic heavy chain variable region CDR H3"
ARYFGDYSGLGNYYYYGMDV

SEQ ID NO: 584 - DNA, 60 bp, Artificial Sequence
  source: /note="Description of Artificial Sequence: Synthetic heavy chain variable region CDR H3"
gcgagatattttggtgactactcagggttggggaactactactactacggtatggacgtc

SEQ ID NO: 585 - DNA, 333 bp, Artificial Sequence
  source: /note="Description of Artificial Sequence: Synthetic light chain variable region"
gatattgtgatgacgcagtctccagtctccctgcccgtcacccctggagagccggcctccatctcctgcaggtctagtcagagcctcctgcattctaatggaaacaactatttggattggtacctgcagaggccagggcagtctccacagctcctcatctatttgggttctaatcgggcctccggggtccctgacaggttcagtggcagtggatcaggcacagattttacactgagaatcagcagagtggaggctgaggatgttggggtttattactgcatgcaagctctacaaactcctcgcttcggcggagggaccaaggtggaaatcaaa

SEQ ID NO: 586 - protein, 111 aa, Artificial Sequence
  source: /note="Description of Artificial Sequence: Synthetic light chain variable region"
DIVMTQSPVSLPVTPGEPASISCRSSQSLLHSNGNNYLDWYLQRPGQSPQLLIYLGSNRASGVPDRFSGSGSGTDFTLRISRVEAEDVGVYYCMQALQTPRFGGGTKVEIK

SEQ ID NO: 587 - protein, 16 aa, Artificial Sequence
  source: /note="Description of Artificial Sequence: Synthetic light chain variable region CDR L1"
RSSQSLLHSNGNNYLD

SEQ ID NO: 588 - DNA, 48 bp, Artificial Sequence
  source: /note="Description of Artificial Sequence: Synthetic light chain variable region CDR L1"
aggtctagtcagagcctcctgcattctaatggaaacaactatttggat

SEQ ID NO: 589 - protein, 7 aa, Artificial Sequence
  source: /note="Description of Artificial Sequence: Synthetic light chain variable region CDR L2"
LGSNRAS

SEQ ID NO: 590 - DNA, 21 bp, Artificial Sequence
  source: /note="Description of Artificial Sequence: Synthetic light chain variable region CDR L2"
ttgggttctaatcgggcctcc

SEQ ID NO: 591 - protein, 8 aa, Artificial Sequence
  source: /note="Description of Artificial Sequence: Synthetic light chain variable region CDR L3"
MQALQTPR

SEQ ID NO: 592 - DNA, 24 bp, Artificial Sequence
  source: /note="Description of Artificial Sequence: Synthetic light chain variable region CDR L3"
atgcaagctctacaaactcctcgc

SEQ ID NO: 593 - DNA, 390 bp, Artificial Sequence
  source: /note="Description of Artificial Sequence: Synthetic heavy chain variable region"
gaggtgcagctggtggagtctgggggacacttggtacagcctggggggtccctgagactctcctgtgcagcctctggattcaccttcagtagctatagtatgaactgggtccgccaggctccagggaaggggctggagtggatttcatacattagtagtagtagtagtaccatgtactacgcagactctgtgaagggccgattcaccatgtccagagacaatgccaagaactcactgtatctgcaaatgaacagcctgagagacgaggacacggctttgtattactgtgcgagagatttcccccctattaatctagcagcgacaacccgaaactactactactatgttatggacgtctggggccaagggaccacggtcaccgtctcctca

SEQ ID NO: 594 - protein, 130 aa, Artificial Sequence
  source: /note="Description of Artificial Sequence: Synthetic heavy chain variable region"
EVQLVESGGHLVQPGGSLRLSCAASGFTFSSYSMNWVRQAPGKGLEWISYISSSSSTMYYADSVKGRFTMSRDNAKNSLYLQMNSLRDEDTALYYCARDFPPINLAATTRNYYYYVMDVWGQGTTVTVSS

SEQ ID NO: 595 - protein, 9 aa, Artificial Sequence
  source: /note="Description of Artificial Sequence: Synthetic heavy chain variable region CDR H1"
FTFSSYSMN

SEQ ID NO: 596 - DNA, 27 bp, Artificial Sequence
  source: /note="Description of Artificial Sequence: Synthetic heavy chain variable region CDR H1"
ttcaccttcagtagctatagtatgaac

SEQ ID NO: 597 - protein, 17 aa, Artificial Sequence
  source: /note="Description of Artificial Sequence: Synthetic heavy chain variable region CDR H2"
YISSSSSTMYYADSVKG

SEQ ID NO: 598 - DNA, 51 bp, Artificial Sequence
  source: /note="Description of Artificial Sequence: Synthetic heavy chain variable region CDR H2"
tacattagtagtagtagtagtaccatgtactacgcagactctgtgaagggc

SEQ ID NO: 599 - protein, 23 aa, Artificial Sequence
  source: /note="Description of Artificial Sequence: Synthetic heavy chain variable region CDR H3"
ARDFPPINLAATTRNYYYYVMDV

SEQ ID NO: 600 - DNA, 69 bp, Artificial Sequence
  source: /note="Description of Artificial Sequence: Synthetic heavy chain variable region CDR H3"
gcgagagatttcccccctattaatctagcagcgacaacccgaaactactactactatgttatggacgtc

SEQ ID NO: 601 - DNA, 321 bp, Artificial Sequence
  source: /note="Description of Artificial Sequence: Synthetic light chain variable region"
gacatccagttgacccagtctccatcctccctgtctgcatctgtaggagacagagtcaccatcacttgccgggcaagtcagagcattagcagctatttaaattggtatcagcagaaaccagggaaagcccctaacctcctaatctatgctacatccaatttgaaaagtggggtcccatcaaggttcagtggcagtggatctgggacagatttcactctcaccatcagcagtctgcaacctgaagattttgcaacttactactgtcaacagagttacagtacctcgtacacttttggccaggggaccaaagtggatatcaaa

SEQ ID NO: 602 - protein, 107 aa, Artificial Sequence
  source: /note="Description of Artificial Sequence: Synthetic light chain variable region"
DIQLTQSPSSLSASVGDRVTITCRASQSISSYLNWYQQKPGKAPNLLIYATSNLKSGVPSRFSGSGSGTDFTLTISSLQPEDFATYYCQQSYSTSYTFGQGTKVDIK

SEQ ID NO: 603 - protein, 11 aa, Artificial Sequence
  source: /note="Description of Artificial Sequence: Synthetic light chain variable region CDR L1"
RASQSISSYLN

SEQ ID NO: 604 - DNA, 33 bp, Artificial Sequence
  source: /note="Description of Artificial Sequence: Synthetic light chain variable region CDR L1"
cgggcaagtcagagcattagcagctatttaaat

SEQ ID NO: 605 - protein, 7 aa, Artificial Sequence
  source: /note="Description of Artificial Sequence: Synthetic light chain variable region CDR L2"
ATSNLKS

SEQ ID NO: 606 - DNA, 21 bp, Artificial Sequence
  source: /note="Description of Artificial Sequence: Synthetic light chain variable region CDR L2"
gctacatccaatttgaaaagt

SEQ ID NO: 607 - protein, 9 aa, Artificial Sequence
  source: /note="Description of Artificial Sequence: Synthetic light chain variable region CDR L3"
QQSYSTSYT

SEQ ID NO: 608 - DNA, 27 bp, Artificial Sequence
  source: /note="Description of Artificial Sequence: Synthetic light chain variable region CDR L3"
caacagagttacagtacctcgtacact

SEQ ID NO: 609 - DNA, 375 bp, Artificial Sequence
  source: /note="Description of Artificial Sequence: Synthetic heavy chain variable region"
gaggtgcagctggtggagtccggccctactctggtgaaacccacacagaccctcacgctgacctgcaccttctctgggttctcactcaccactattggagtgggtgtgggctggatccgtcagcccccaggaaaggccctggagtttcttggaatcgtttattgggatgatgataagcggtacagcccatctctgaagagcaggctcaccatcaccaaggacacctccaaaaaccaggtggtccttacgatgaccacgttggcccctgaggacacaggcacatattactgtacatacgcccgctatagcagtgccttgttcgggggttactactttcactcgtggggccagggaaccctggtcaccgtctcctca

SEQ ID NO: 610 - protein, 125 aa, Artificial Sequence
  source: /note="Description of Artificial Sequence: Synthetic heavy chain variable region"
EVQLVESGPTLVKPTQTLTLTCTFSGFSLTTIGVGVGWIRQPPGKALEFLGIVYWDDDKRYSPSLKSRLTITKDTSKNQVVLTMTTLAPEDTGTYYCTYARYSSALFGGYYFHSWGQGTLVTVSS

SEQ ID NO: 611 - protein, 11 aa, Artificial Sequence
  source: /note="Description of Artificial Sequence: Synthetic heavy chain variable region CDR H1"
FSLTTIGVGVG

SEQ ID NO: 612 - DNA, 33 bp, Artificial Sequence
  source: /note="Description of Artificial Sequence: Synthetic heavy chain variable region CDR H1"
ttctcactcaccactattggagtgggtgtgggc

SEQ ID NO: 613 - protein, 16 aa, Artificial Sequence
  source: /note="Description of Artificial Sequence: Synthetic heavy chain variable region CDR H2"
IVYWDDDKRYSPSLKS

SEQ ID NO: 614 - DNA, 48 bp, Artificial Sequence
  source: /note="Description of Artificial Sequence: Synthetic heavy chain variable region CDR H2"
atcgtttattgggatgatgataagcggtacagcccatctctgaagagc

SEQ ID NO: 615 - protein, 17 aa, Artificial Sequence
  source: /note="Description of Artificial Sequence: Synthetic heavy chain variable region CDR H3"
TYARYSSALFGGYYFHS

SEQ ID NO: 616 - DNA, 51 bp, Artificial Sequence
  source: /note="Description of Artificial Sequence: Synthetic heavy chain variable region CDR H3"
acatacgcccgctatagcagtgccttgttcgggggttactactttcactcg

SEQ ID NO: 617 - DNA, 327 bp, Artificial Sequence
  source: /note="Description of Artificial Sequence: Synthetic light chain variable region"
cagtctgtcctgacgcagccgccctcggtgtcagtggccccaggacagacggccaagattacctgtgggggaaacgacattggaagtagaagtgtgcactggtaccagcagaagccaggccaggcccctgtgctggtcgtctatgataatagcgaccggccctcagggatccctgaacgattctctggctccaattctggagacacggccaccctgaccatcagcagggtcgaagccggggatgaggccgtctattactgtcaggtgtgggagagtagtggtgatcatccgaggatattcggcggagggaccaagctcaccgtccta

SEQ ID NO: 618 - protein, 109 aa, Artificial Sequence
  source: /note="Description of Artificial Sequence: Synthetic light chain variable region"
QSVLTQPPSVSVAPGQTAKITCGGNDIGSRSVHWYQQKPGQAPVLVVYDNSDRPSGIPERFSGSNSGDTATLTISRVEAGDEAVYYCQVWESSGDHPRIFGGGTKLTVL

SEQ ID NO: 619 - protein, 11 aa, Artificial Sequence
  source: /note="Description of Artificial Sequence: Synthetic light chain variable region CDR L1"
GGNDIGSRSVH

SEQ ID NO: 620 - DNA, 33 bp, Artificial Sequence
  source: /note="Description of Artificial Sequence: Synthetic light chain variable region CDR L1"
gggggaaacgacattggaagtagaagtgtgcac

SEQ ID NO: 621 - protein, 7 aa, Artificial Sequence
  source: /note="Description of Artificial Sequence: Synthetic light chain variable region CDR L2"
DNSDRPS

SEQ ID NO: 622 - DNA, 21 bp, Artificial Sequence
  source: /note="Description of Artificial Sequence: Synthetic light chain variable region CDR L2"
gataatagcgaccggccctca

SEQ ID NO: 623 - protein, 12 aa, Artificial Sequence
  source: /note="Description of Artificial Sequence: Synthetic light chain variable region CDR L3"
QVWESSGDHPRI

SEQ ID NO: 624 - DNA, 36 bp, Artificial Sequence
  source: /note="Description of Artificial Sequence: Synthetic light chain variable region CDR L3"
caggtgtgggagagtagtggtgatcatccgaggata

SEQ ID NO: 625 - DNA, 369 bp, Artificial Sequence
  source: /note="Description of Artificial Sequence: Synthetic heavy chain variable region"
gaggtgcagctggtggagtctgggggcgccctggtaaagccgggggggtcccttagactctcctgtgtaggcactggactcactttcactactgcctacatgagctgggcccgccaggctccagggaaggggctggagtgggttggtcgtattctgagcaaaagtgatggtgggacaacagactaccctacacccgtcaaaggcagattcaccatctcaagagatgaatctaaaaacaccctgtatctgcaaatgaacagcctgaaaatcgaggacacagccgtctattattgtaccacagatagggggataacagctcgtcctatcttcgactcctggggccagggaaccctggtcaccgtctcctca

SEQ ID NO: 626 - protein, 123 aa, Artificial Sequence
  source: /note="Description of Artificial Sequence: Synthetic heavy chain variable region"
EVQLVESGGALVKPGGSLRLSCVGTGLTFTTAYMSWARQAPGKGLEWVGRILSKSDGGTTDYPTPVKGRFTISRDESKNTLYLQMNSLKIEDTAVYYCTTDRGITARPIFDSWGQGTLVTVSS

SEQ ID NO: 627 - protein, 9 aa, Artificial Sequence
  source: /note="Description of Artificial Sequence: Synthetic heavy chain variable region CDR H1"
LTFTTAYMS

SEQ ID NO: 628 - DNA, 27 bp, Artificial Sequence
  source: /note="Description of Artificial Sequence: Synthetic heavy chain variable region CDR H1"
ctcactttcactactgcctacatgagc

SEQ ID NO: 629 - protein, 19 aa, Artificial Sequence
  source: /note="Description of Artificial Sequence: Synthetic heavy chain variable region CDR H2"
RILSKSDGGTTDYPTPVKG

SEQ ID NO: 630 - DNA, 57 bp, Artificial Sequence
  source: /note="Description of Artificial Sequence: Synthetic heavy chain variable region CDR H2"
cgtattctgagcaaaagtgatggtgggacaacagactaccctacacccgtcaaaggc

SEQ ID NO: 631 - protein, 14 aa, Artificial Sequence
  source: /note="Description of Artificial Sequence: Synthetic heavy chain variable region CDR H3"
TTDRGITARPIFDS

SEQ ID NO: 632 - DNA, 42 bp, Artificial Sequence; identical to SEQ ID NO: 40
  source: /note="Description of Artificial Sequence: Synthetic heavy chain variable region CDR H3"

SEQ ID NO: 633 - DNA, 333 bp, Artificial Sequence
  source: /note="Description of Artificial Sequence: Synthetic light chain variable region"
cagtctgtgctgacgcagccgccctcagtgtctggggccctagggcggagggtcaccatctcctgcactgggagcagctccaacatcggggcaggttatgatgtacattggtacaggcaacttccaggaacagcccccaaactcctcatttatggtaacaccaaacggccctcaggggtccctgaccgattctctggctccaagtatgccacctcagcctccctggccatcactgggctccaggctgacgatgacgctgattattactgccagtcctatgacggcggcctgagtggttatgtcttcggaactgggaccaaggtcaccgtccta

SEQ ID NO: 634 - protein, 111 aa, Artificial Sequence
  source: /note="Description of Artificial Sequence: Synthetic light chain variable region"
QSVLTQPPSVSGALGRRVTISCTGSSSNIGAGYDVHWYRQLPGTAPKLLIYGNTKRPSGVPDRFSGSKYATSASLAITGLQADDDADYYCQSYDGGLSGYVFGTGTKVTVL

SEQ ID NO: 635 - protein, 14 aa, Artificial Sequence
  source: /note="Description of Artificial Sequence: Synthetic light chain variable region CDR L1"
TGSSSNIGAGYDVH

SEQ ID NO: 636 - DNA, 42 bp, Artificial Sequence; identical to SEQ ID NO: 572
  source: /note="Description of Artificial Sequence: Synthetic light chain variable region CDR L1"

SEQ ID NO: 637 - protein, 7 aa, Artificial Sequence
  source: /note="Description of Artificial Sequence: Synthetic light chain variable region CDR L2"
GNTKRPS

SEQ ID NO: 638 - DNA, 21 bp, Artificial Sequence
  source: /note="Description of Artificial Sequence: Synthetic light chain variable region CDR L2"
ggtaacaccaaacggccctca

SEQ ID NO: 639 - protein, 11 aa, Artificial Sequence
  source: /note="Description of Artificial Sequence: Synthetic light chain variable region CDR L3"
QSYDGGLSGYV

SEQ ID NO: 640 - DNA, 33 bp, Artificial Sequence; identical to SEQ ID NO: 48
  source: /note="Description of Artificial Sequence: Synthetic light chain variable region CDR L3"

SEQ ID NO: 641 - DNA, 372 bp, Artificial Sequence
  source: /note="Description of Artificial Sequence: Synthetic heavy chain variable region"
caggtccagctggtgcagtctgggggaggcctggtcaagcctggggggtccctgagactctcctgtgcaggctctggattcaccttcagtagctataccctgaactgggtccgccaggctccagggaaggggctggagtgggtctcatccattagtagtagtagtacttacatatactacgcagactcagtgaagggccgattcaccatctccagagacaacgccaagaactcactgcatctgcaaatgaacagcctgagagccgaggacacggctgtgtattattgtgcgagagctgactatgatagaagtgtttatcacctcaattggttcgacccctggggccagggaaccctggtcaccgtctcctca

SEQ ID NO: 642 - protein, 124 aa, Artificial Sequence
  source: /note="Description of Artificial Sequence: Synthetic heavy chain variable region"
QVQLVQSGGGLVKPGGSLRLSCAGSGFTFSSYTLNWVRQAPGKGLEWVSSISSSSTYIYYADSVKGRFTISRDNAKNSLHLQMNSLRAEDTAVYYCARADYDRSVYHLNWFDPWGQGTLVTVSS

SEQ ID NO: 643 - protein, 9 aa, Artificial Sequence
  source: /note="Description of Artificial Sequence: Synthetic heavy chain variable region CDR H1"
FTFSSYTLN

SEQ ID NO: 644 - DNA, 27 bp, Artificial Sequence
  source: /note="Description of Artificial Sequence: Synthetic heavy chain variable region CDR H1"
ttcaccttcagtagctataccctgaac

SEQ ID NO: 645 - protein, 17 aa, Artificial Sequence
  source: /note="Description of Artificial Sequence: Synthetic heavy chain variable region CDR H2"
SISSSSTYIYYADSVKG

SEQ ID NO: 646 - DNA, 51 bp, Artificial Sequence
  source: /note="Description of Artificial Sequence: Synthetic heavy chain variable region CDR H2"
tccattagtagtagtagtacttacatatactacgcagactcagtgaagggc

SEQ ID NO: 647 - protein, 17 aa, Artificial Sequence
  source: /note="Description of Artificial Sequence: Synthetic heavy chain variable region CDR H3"
ARADYDRSVYHLNWFDP

SEQ ID NO: 648 - DNA, 51 bp, Artificial Sequence
  source: /note="Description of Artificial Sequence: Synthetic heavy chain variable region CDR H3"
gcgagagctgactatgatagaagtgtttatcacctcaattggttcgacccc

SEQ ID NO: 649 - DNA, 336 bp, Artificial Sequence
  source: /note="Description of Artificial Sequence: Synthetic light chain variable region"
cagtctgtgttgacgcagccgccctcagtgtctggggccccagggcagagggtcaccatctcctgcactgggagcagctccaacatcggggcaggttatgatgtacactggtaccagcaacttccaggagcagcccccaaactcctcatctatggtaacaccaatcggccctcaggggtccctgaccgattttctggctccaagtctggcacctcagcctccctggccatcactgggctccaggctgacgatgaggctgattattactgccagtcctatgacagcagcctgagtggcacttgggtgttcggcggagggaccaagctcaccgtccta

SEQ ID NO: 650 - protein, 112 aa, Artificial Sequence
  source: /note="Description of Artificial Sequence: Synthetic light chain variable region"
QSVLTQPPSVSGAPGQRVTISCTGSSSNIGAGYDVHWYQQLPGAAPKLLIYGNTNRPSGVPDRFSGSKSGTSASLAITGLQADDEADYYCQSYDSSLSGTWVFGGGTKLTVL

SEQ ID NO: 651 - protein, 14 aa, Artificial Sequence
  source: /note="Description of Artificial Sequence: Synthetic light chain variable region CDR L1"
TGSSSNIGAGYDVH

SEQ ID NO: 652 - DNA, 42 bp, Artificial Sequence; identical to SEQ ID NO: 60
  source: /note="Description of Artificial Sequence: Synthetic light chain variable region CDR L1"

SEQ ID NO: 653 - protein, 7 aa, Artificial Sequence
  source: /note="Description of Artificial Sequence: Synthetic light chain variable region CDR L2"
GNTNRPS

SEQ ID NO: 654 - DNA, 21 bp, Artificial Sequence
  source: /note="Description of Artificial Sequence: Synthetic light chain variable region CDR L2"
ggtaacaccaatcggccctca

SEQ ID NO: 655 - protein, 12 aa, Artificial Sequence
  source: /note="Description of Artificial Sequence: Synthetic light chain variable region CDR L3"
QSYDSSLSGTWV

SEQ ID NO: 656 - DNA, 36 bp, Artificial Sequence
  source: /note="Description of Artificial Sequence: Synthetic light chain variable region CDR L3"
cagtcctatgacagcagcctgagtggcacttgggtg

SEQ ID NO: 657 - DNA, 372 bp, Artificial Sequence
  source: /note="Description of Artificial Sequence: Synthetic heavy chain variable region"
gaggtgcagctgttggagtctgggggaggcttggtacagccagggcggtccctgagactctcttgttcaggttctggattcacctttggggattatgctctgagctgggtccgccaggctccagggaaggggctggagtgggtaggtttcattagaagcaaagcctatggtgggacaacagaatacgccgcgtctgtgaaaggcagattcaccatctcaagagatgattccaaaagcatcgcctatctgcaaatgaacagcctgaaaaccgaggacacagccgtgtattactgtactatggctgtagtggtgccaggtgctacagatgcttttgatatctggggccaagggacaatggtcaccgtctcttca

SEQ ID NO: 658 - protein, 124 aa, Artificial Sequence
  source: /note="Description of Artificial Sequence: Synthetic heavy chain variable region"
EVQLLESGGGLVQPGRSLRLSCSGSGFTFGDYALSWVRQAPGKGLEWVGFIRSKAYGGTTEYAASVKGRFTISRDDSKSIAYLQMNSLKTEDTAVYYCTMAVVVPGATDAFDIWGQGTMVTVSS

SEQ ID NO: 659 - protein, 9 aa, Artificial Sequence
  source: /note="Description of Artificial Sequence: Synthetic heavy chain variable region CDR H1"
FTFGDYALS

SEQ ID NO: 660 - DNA, 27 bp, Artificial Sequence
  source: /note="Description of Artificial Sequence: Synthetic heavy chain variable region CDR H1"
ttcacctttggggattatgctctgagc

SEQ ID NO: 661 - protein, 19 aa, Artificial Sequence
  source: /note="Description of Artificial Sequence: Synthetic heavy chain variable region CDR H2"
FIRSKAYGGTTEYAASVKG

SEQ ID NO: 662 - DNA, 57 bp, Artificial Sequence
  source: /note="Description of Artificial Sequence: Synthetic heavy chain variable region CDR H2"
ttcattagaagcaaagcctatggtgggacaacagaatacgccgcgtctgtgaaaggc

SEQ ID NO: 663 - protein, 15 aa, Artificial Sequence
  source: /note="Description of Artificial Sequence: Synthetic heavy chain variable region CDR H3"
TMAVVVPGATDAFDI

SEQ ID NO: 664 - DNA, 45 bp, Artificial Sequence
  source: /note="Description of Artificial Sequence: Synthetic heavy chain variable region CDR H3"
actatggctgtagtggtgccaggtgctacagatgcttttgatatc

SEQ ID NO: 665 - DNA, 333 bp, Artificial Sequence
  source: /note="Description of Artificial Sequence: Synthetic light chain variable region"
aattttatgctgactcagccccactctgtgtcggagtctccggggaagacggtaaccatctcctgtacccgcagcagtggcagcattgccagcgactatgtgcagtggttccagcagcgcccgggcagttcccccgccactgtgatctatcaggataaccaaagaccctctggggtccctgatcggttctctggctccatcgacacctcctccaactctgcctccctcaccatctctggactgaagactgaggacgaggctgactactactgtcactcttatgatagtagcaatccttgggtgttcggcggagggaccaagctcaccgtccta

SEQ ID NO: 666 - protein, 111 aa, Artificial Sequence
  source: /note="Description of Artificial Sequence: Synthetic light chain variable region"
NFMLTQPHSVSESPGKTVTISCTRSSGSIASDYVQWFQQRPGSSPATVIYQDNQRPSGVPDRFSGSIDTSSNSASLTISGLKTEDEADYYCHSYDSSNPWVFGGGTKLTVL

SEQ ID NO: 667 - protein, 13 aa, Artificial Sequence
  source: /note="Description of Artificial Sequence: Synthetic light chain variable region CDR L1"
TRSSGSIASDYVQ

SEQ ID NO: 668 - DNA, 39 bp, Artificial Sequence
  source: /note="Description of Artificial Sequence: Synthetic light chain variable region CDR L1"
acccgcagcagtggcagcattgccagcgactatgtgcag

SEQ ID NO: 669 - protein, 7 aa, Artificial Sequence
  source: /note="Description of Artificial Sequence: Synthetic light chain variable region CDR L2"
QDNQRPS

SEQ ID NO: 670 - DNA, 21 bp, Artificial Sequence
  source: /note="Description of Artificial Sequence: Synthetic light chain variable region CDR L2"
caggataaccaaagaccctct

SEQ ID NO: 671 - protein, 10 aa, Artificial Sequence
  source: /note="Description of Artificial Sequence: Synthetic light chain variable region CDR L3"
HSYDSSNPWV

SEQ ID NO: 672 - DNA, 30 bp, Artificial Sequence
  source: /note="Description of Artificial Sequence: Synthetic light chain variable region CDR L3"
cactcttatgatagtagcaatccttgggtg

SEQ ID NO: 673 - DNA, 369 bp, Artificial Sequence
  source: /note="Description of Artificial Sequence: Synthetic heavy chain variable region"
gaggtgcagctggtggagtccggaggaggcttgatccagccgggggggtccctgagactctcctgtgcagtctctgggttcagcgtcagcagcaactatataagttgggtccgccagcctccagggaaggggctggagtgggtctcagttagttatagtagtggtgtcacagactacgcagactccgtgaagggccgattcaccacctccagagacaactccaagaacacgctgtatcttcaaatgaacagcctgagaggcgaagacacggccgtctattactgtgcgagagagttggtgccaaatttctatgaaagtcatggttatttttccgtgtggggccagggaaccctggtcaccgtctcctca

SEQ ID NO: 674 - protein, 123 aa, Artificial Sequence
  source: /note="Description of Artificial Sequence: Synthetic heavy chain variable region"
EVQLVESGGGLIQPGGSLRLSCAVSGFSVSSNYISWVRQPPGKGLEWVSVSYSSGVTDYADSVKGRFTTSRDNSKNTLYLQMNSLRGEDTAVYYCARELVPNFYESHGYFSVWGQGTLVTVSS

SEQ ID NO: 675 - protein, 9 aa, Artificial Sequence
  source: /note="Description of Artificial Sequence: Synthetic heavy chain variable region CDR H1"
FSVSSNYIS

SEQ ID NO: 676 - DNA, 27 bp, Artificial Sequence
  source: /note="Description of Artificial Sequence: Synthetic heavy chain variable region CDR H1"
ttcagcgtcagcagcaactatataagt

SEQ ID NO: 677 - protein, 16 aa, Artificial Sequence
  source: /note="Description of Artificial Sequence: Synthetic heavy chain variable region CDR H2"
VSYSSGVTDYADSVKG

SEQ ID NO: 678 - DNA, 48 bp, Artificial Sequence
  source: /note="Description of Artificial Sequence: Synthetic heavy chain variable region CDR H2"
gttagttatagtagtggtgtcacagactacgcagactccgtgaagggc

SEQ ID NO: 679 - protein, 17 aa, Artificial Sequence
  source: /note="Description of Artificial Sequence: Synthetic heavy chain variable region CDR H3"
ARELVPNFYESHGYFSV

SEQ ID NO: 680 - DNA, 51 bp, Artificial Sequence
  source: /note="Description of Artificial Sequence: Synthetic heavy chain variable region CDR H3"
gcgagagagttggtgccaaatttctatgaaagtcatggttatttttccgtg

SEQ ID NO: 681 - DNA, 321 bp, Artificial Sequence
  source: /note="Description of Artificial Sequence: Synthetic light chain variable region"
gatattgtgatgactcagtctccaggcaccctgtctttgtctccaggggaaagagccaccctctcctgcagggccagtcagagagttgacagcagctacttagcctggtaccagcagaaacctggccaggctcccaggctcctcatctatggtggatccagcagggccactggcatcccagacaggttcagtggcagtgggtctgggacagacttcactctcaccatcagcaggctggagcctgaagattttgcgttgtattactgtcagcagtatggtttctcacagacgttcggccaagggaccaaggtggagatcaaa

SEQ ID NO: 682 - protein, 107 aa, Artificial Sequence
  source: /note="Description of Artificial Sequence: Synthetic light chain variable region"
DIVMTQSPGTLSLSPGERATLSCRASQRVDSSYLAWYQQKPGQAPRLLIYGGSSRATGIPDRFSGSGSGTDFTLTISRLEPEDFALYYCQQYGFSQTFGQGTKVEIK

SEQ ID NO: 683 - protein, 12 aa, Artificial Sequence
  source: /note="Description of Artificial Sequence: Synthetic light chain variable region CDR L1"
RASQRVDSSYLA

SEQ ID NO: 684 - DNA, 36 bp, Artificial Sequence
  source: /note="Description of Artificial Sequence: Synthetic light chain variable region CDR L1"
agggccagtcagagagttgacagcagctacttagcc

SEQ ID NO: 685 - protein, 7 aa, Artificial Sequence
  source: /note="Description of Artificial Sequence: Synthetic light chain variable region CDR L2"
GGSSRAT

SEQ ID NO: 686 - DNA, 21 bp, Artificial Sequence
  source: /note="Description of Artificial Sequence: Synthetic light chain variable region CDR L2"
ggtggatccagcagggccact

SEQ ID NO: 687 - protein, 8 aa, Artificial Sequence
  source: /note="Description of Artificial Sequence: Synthetic light chain variable region CDR L3"
QQYGFSQT

SEQ ID NO: 688 - DNA, 24 bp, Artificial Sequence
  source: /note="Description of Artificial Sequence: Synthetic light chain variable region CDR L3"
cagcagtatggtttctcacagacg

SEQ ID NO: 689 - DNA, 378 bp, Artificial Sequence
  source: /note="Description of Artificial Sequence: Synthetic heavy chain variable region"
gaggtgcagctgttggagactgggggaggcttggttaagccgggggggtccctgagactctcctgtgaagccactggattcactttcagcgactttgccatgagctgggtccgccaggctccagggaaggggctggagtgggtctcactgattaaaagtagtgattatccatactatgcagactccgtgaggggccgcttcaccatctccagagacaattccaagaacaccctgtatctgcgaatggacaacctgagagccgacgacacggccgtgtattactgtgccaaggacgccgatttttggagtggtgaggcctacaatggagggtacaactttgactcctggggccagggaaccctggtcaccgtctcctca

SEQ ID NO: 690 - protein, 126 aa, Artificial Sequence
  source: /note="Description of Artificial Sequence: Synthetic heavy chain variable region"
EVQLLETGGGLVKPGGSLRLSCEATGFTFSDFAMSWVRQAPGKGLEWVSLIKSSDYPYYADSVRGRFTISRDNSKNTLYLRMDNLRADDTAVYYCAKDADFWSGEAYNGGYNFDSWGQGTLVTVSS

SEQ ID NO: 691 - protein, 9 aa, Artificial Sequence
  source: /note="Description of Artificial Sequence: Synthetic heavy chain variable region CDR H1"
FTFSDFAMS

SEQ ID NO: 692 - DNA, 27 bp, Artificial Sequence
  source: /note="Description of Artificial Sequence: Synthetic heavy chain variable region CDR H1"
ttcactttcagcgactttgccatgagc

SEQ ID NO: 693 - protein, 16 aa, Artificial Sequence
  source: /note="Description of Artificial Sequence: Synthetic heavy chain variable region CDR H2"
LIKSSDYPYYADSVRG

SEQ ID NO: 694 - DNA, 48 bp, Artificial Sequence
  source: /note="Description of Artificial Sequence: Synthetic heavy chain variable region CDR H2"
ctgattaaaagtagtgattatccatactatgcagactccgtgaggggc

SEQ ID NO: 695 - protein, 20 aa, Artificial Sequence
  source: /note="Description of Artificial Sequence: Synthetic heavy chain variable region CDR H3"
AKDADFWSGEAYNGGYNFDS

SEQ ID NO: 696 - DNA, 60 bp, Artificial Sequence
  source: /note="Description of Artificial Sequence: Synthetic heavy chain variable region CDR H3"
gccaaggacgccgatttttggagtggtgaggcctacaatggagggtacaactttgactcc

SEQ ID NO: 697 - DNA, 324 bp, Artificial Sequence
  source: /note="Description of Artificial Sequence: Synthetic light chain variable region"
gaaattgtattgacacagtctccagccaccctgtctgtctctccaggggaaagagccaccctctcctgcagggccagtcagagtattggcaccaacttggcctggtaccagcaaaaacctggccaggctccccggctcctcatctttggtgcctcaaccagggccacgggtatcccagccaggttcactggcagtgggtctgggacagagttcactctcaccatcggcagcctccagtctgaagattttgcagtttattactgtcagcagtacaatcagtggcctccgatcactttcggcggagggaccaaggtggaaatcaaa

SEQ ID NO: 698 - protein, 108 aa, Artificial Sequence
  source: /note="Description of Artificial Sequence: Synthetic light chain variable region"
EIVLTQSPATLSVSPGERATLSCRASQSIGTNLAWYQQKPGQAPRLLIFGASTRATGIPARFTGSGSGTEFTLTIGSLQSEDFAVYYCQQYNQWPPITFGGGTKVEIK

SEQ ID NO: 699 - protein, 11 aa, Artificial Sequence
  source: /note="Description of Artificial Sequence: Synthetic light chain variable region CDR L1"
RASQSIGTNLA

SEQ ID NO: 700 - DNA, 33 bp, Artificial Sequence
  source: /note="Description of Artificial Sequence: Synthetic light chain variable region CDR L1"
agggccagtcagagtattggcaccaacttggcc

SEQ ID NO: 701 - protein, 7 aa, Artificial Sequence
  source: /note="Description of Artificial Sequence: Synthetic light chain variable region CDR L2"
GASTRAT

SEQ ID NO: 702 - DNA, 21 bp, Artificial Sequence
  source: /note="Description of Artificial Sequence: Synthetic light chain variable region CDR L2"
ggtgcctcaaccagggccacg

SEQ ID NO: 703 - protein, 10 aa, Artificial Sequence
  source: /note="Description of Artificial Sequence: Synthetic light chain variable region CDR L3"
QQYNQWPPIT

SEQ ID NO: 704 - DNA, 30 bp, Artificial Sequence
  source: /note="Description of Artificial Sequence: Synthetic light chain variable region CDR L3"
cagcagtacaatcagtggcctccgatcact

SEQ ID NO: 705 - DNA, 372 bp, Artificial Sequence
  source: /note="Description of Artificial Sequence: Synthetic heavy chain variable region"
gaggtgcagctgttggagtctgggggaggcgtggtccagcctgggaagtccctgagactctcctgtgtagcctctggattcaccttcggtgactatggcatgcactgggtccgccaggctccaggcaaggggctggagtgggtggcagttatatcagatggtggaagcactaaatactatgcagactccgtgaagggccgattcaccatcgccagagacaattccaagaacacgctgaatctgcaaatgaacagcctgagagctgaggacacggctgtgtattactgtgcgaaagatttggcttggatttttggactgggtgcttcatatatggacgtctggggccaagggaccctggtcaccgtctcctca

SEQ ID NO: 706 - protein, 124 aa, Artificial Sequence
  source: /note="Description of Artificial Sequence: Synthetic heavy chain variable region"
EVQLLESGGGVVQPGKSLRLSCVASGFTFGDYGMHWVRQAPGKGLEWVAVISDGGSTKYYADSVKGRFTIARDNSKNTLNLQMNSLRAEDTAVYYCAKDLAWIFGLGASYMDVWGQGTLVTVSS

SEQ ID NO: 707 - protein, 9 aa, Artificial Sequence
  source: /note="Description of Artificial Sequence: Synthetic heavy chain variable region CDR H1"
FTFGDYGMH

SEQ ID NO: 708 - DNA, 27 bp, Artificial Sequence
  source: /note="Description of Artificial Sequence: Synthetic heavy chain variable region CDR H1"
ttcaccttcggtgactatggcatgcac

SEQ ID NO: 709 - protein, 17 aa, Artificial Sequence
  source: /note="Description of Artificial Sequence: Synthetic heavy chain variable region CDR H2"
VISDGGSTKYYADSVKG

SEQ ID NO: 710 - DNA, 51 bp, Artificial Sequence
  source: /note="Description of Artificial Sequence: Synthetic heavy chain variable region CDR H2"
gttatatcagatggtggaagcactaaatactatgcagactccgtgaagggc

SEQ ID NO: 711 - protein, 17 aa, Artificial Sequence
  source: /note="Description of Artificial Sequence: Synthetic heavy chain variable region CDR H3"
AKDLAWIFGLGASYMDV

SEQ ID NO: 712 - DNA, 51 bp, Artificial Sequence
  source: /note="Description of Artificial Sequence: Synthetic heavy chain variable region CDR H3"
gcgaaagatttggcttggatttttggactgggtgcttcatatatggacgtc

SEQ ID NO: 713 - DNA, 330 bp, Artificial Sequence
  source: /note="Description of Artificial Sequence: Synthetic light chain variable region"
gacatccagttgacccagtctccaggcaccctgtctttgtctccaggggaaagagccaccctctcctgcagggccagtcagactgttagtagcagctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctttcgggctcactttcggcggagggaccaaggtggaaatcaaa

SEQ ID NO: 714 - protein, 110 aa, Artificial Sequence
  source: /note="Description of Artificial Sequence: Synthetic light chain variable region"
DIQLTQSPGTLSLSPGERATLSCRASQTVSSSYLAWYQQKPGQAPRLLIYDASSRATGIPDRFSGSGSGTDFTLTISRLEPEDFAVYYCQQYGSSPFGLTFGGGTKVEIK

SEQ ID NO: 715 - protein, 12 aa, Artificial Sequence
  source: /note="Description of Artificial Sequence: Synthetic light chain variable region CDR L1"
RASQTVSSSYLA

SEQ ID NO: 716 - DNA, 36 bp, Artificial Sequence
  source: /note="Description of Artificial Sequence: Synthetic light chain variable region CDR L1"
agggccagtcagactgttagtagcagctacttagcc

SEQ ID NO: 717 - protein, 7 aa, Artificial Sequence
  source: /note="Description of Artificial Sequence: Synthetic light chain variable region CDR L2"
DASSRAT

SEQ ID NO: 718 - DNA, 21 bp, Artificial Sequence
  source: /note="Description of Artificial Sequence: Synthetic light chain variable region CDR L2"
gatgcatccagcagggccact

SEQ ID NO: 719 - protein, 11 aa, Artificial Sequence
  source: /note="Description of Artificial Sequence: Synthetic light chain variable region CDR L3"
QQYGSSPFGLT

SEQ ID NO: 720 - DNA, 33 bp, Artificial Sequence
  source: /note="Description of Artificial Sequence: Synthetic light chain variable region CDR L3"
cagcagtatggtagctcacctttcgggctcact

SEQ ID NO: 721 - DNA, 369 bp, Artificial Sequence
  source: /note="Description of Artificial Sequence: Synthetic heavy chain variable region"
caggtccagctggtgcagtctgggggaggcttggtacagccgggggggtccctgcgactctcctgtgcagcctctggattcacctttgggagacatgccatgacgtgggtccgccaggctccagggaaggggctggagtgggtcgcaggcattactgctactggggaccccacatactacccagactccgtgaagggccggttcgccgtctccagagacaactcccggaacacgctttatctgcaaatggacagtctgagagtcgaggacacggccctatattactgtgcgagaagttgggatgactacggtgacctggactggtacttcgctctctggggccgtggcacaatggtcaccgtctcttca

SEQ ID NO: 722 - protein, 123 aa, Artificial Sequence
  source: /note="Description of Artificial Sequence: Synthetic heavy chain variable region"
QVQLVQSGGGLVQPGGSLRLSCAASGFTFGRHAMTWVRQAPGKGLEWVAGITATGDPTYYPDSVKGRFAVSRDNSRNTLYLQMDSLRVEDTALYYCARSWDDYGDLDWYFALWGRGTMVTVSS

SEQ ID NO: 723 - protein, 9 aa, Artificial Sequence
  source: /note="Description of Artificial Sequence: Synthetic heavy chain variable region CDR H1"
FTFGRHAMT

SEQ ID NO: 724 - DNA, 27 bp, Artificial Sequence
  source: /note="Description of Artificial Sequence: Synthetic heavy chain variable region CDR H1"
ttcacctttgggagacatgccatgacg

SEQ ID NO: 725 - protein, 17 aa, Artificial Sequence
  source: /note="Description of Artificial Sequence: Synthetic heavy chain variable region CDR H2"
GITATGDPTYYPDSVKG

SEQ ID NO: 726 - DNA, 51 bp, Artificial Sequence
  source: /note="Description of Artificial Sequence: Synthetic heavy chain variable region CDR H2"
ggcattactgctactggggaccccacatactacccagactccgtgaagggc

SEQ ID NO: 727 - protein, 16 aa, Artificial Sequence
  source: /note="Description of Artificial Sequence: Synthetic heavy chain variable region CDR H3"
ARSWDDYGDLDWYFAL

SEQ ID NO: 728 - DNA, 48 bp, Artificial Sequence
  source: /note="Description of Artificial Sequence: Synthetic heavy chain variable region CDR H3"
gcgagaagttgggatgactacggtgacctggactggtacttcgctctc

SEQ ID NO: 729 - DNA, 324 bp, Artificial Sequence
  source: /note="Description of Artificial Sequence: Synthetic light chain variable region"
gaaattgtgatgacacagtctccagccatcctgtctgtgtctccaggggaaagagccaccctctcctgcagggccagtcagagtgttagcagcagcttggcctggtaccagcagaaacctggccaggctcctaggctcctcatctacggtgcatccaccagggccactggtatcccaccccggttcagtggcagtgggtctgggacacaattcactctcaccatcagcagcctgcagtctgaagatgttgcagtatattactgtcagcagtatagtgactggcctccgctcactttcggcggggggaccaaggtggaaatcaaa

SEQ ID NO: 730 - protein, 108 aa, Artificial Sequence
  source: /note="Description of Artificial Sequence: Synthetic light chain variable region"
EIVMTQSPAILSVSPGERATLSCRASQSVSSSLAWYQQKPGQAPRLLIYGASTRATGIPPRFSGSGSGTQFTLTISSLQSEDVAVYYCQQYSDWPPLTFGGGTKVEIK

SEQ ID NO: 731 - protein, 11 aa, Artificial Sequence
  source: /note="Description of Artificial Sequence: Synthetic light chain variable region CDR L1"
RASQSVSSSLA

SEQ ID NO: 732 - DNA, 33 bp, Artificial Sequence
  source: /note="Description of Artificial Sequence: Synthetic light chain variable region CDR L1"
agggccagtcagagtgttagcagcagcttggcc

SEQ ID NO: 733 - protein, 7 aa, Artificial Sequence
  source: /note="Description of Artificial Sequence: Synthetic light chain variable region CDR L2"
GASTRAT

SEQ ID NO: 734 - DNA, 21 bp, Artificial Sequence
  source: /note="Description of Artificial Sequence: Synthetic light chain variable region CDR L2"
ggtgcatccaccagggccact

SEQ ID NO: 735 - protein, 10 aa, Artificial Sequence
  source: /note="Description of Artificial Sequence: Synthetic light chain variable region CDR L3"
QQYSDWPPLT

SEQ ID NO: 736 - DNA, 30 bp, Artificial Sequence
  source: /note="Description of Artificial Sequence: Synthetic light chain variable region CDR L3"
cagcagtatagtgactggcctccgctcact

SEQ ID NO: 737 - DNA, 375 bp, Artificial Sequence
  source: /note="Description of Artificial Sequence: Synthetic heavy chain variable region"
gaggtgcagctgttggagtctgggggaggcttggtcaagcctggagggtccctgagactctcctgtggagcctctggattcaagttcagtgactactacatgagttggatccgccaggctccagggaaggggctagagtgggtttcacacattagtagtagtaatagttacataaactacgcagactctgtgaagggccgattcaccatctccagggacaacgccaggaactcactgtctctgcaaatgaacagcctgagagccgaggacacggccgtgtattactgtgcgagattccccctttactgtagtcgttcctcctgctcccattacgttgactactggggccagggaaccctggtcaccgtctcctca

SEQ ID NO: 738 - protein, 125 aa, Artificial Sequence
  source: /note="Description of Artificial Sequence: Synthetic heavy chain variable region"
EVQLLESGGGLVKPGGSLRLSCGASGFKFSDYYMSWIRQAPGKGLEWVSHISSSNSYINYADSVKGRFTISRDNARNSLSLQMNSLRAEDTAVYYCARFPLYCSRSSCSHYVDYWGQGTLVTVSS

SEQ ID NO: 739 - protein, 9 aa, Artificial Sequence
  source: /note="Description of Artificial Sequence: Synthetic heavy chain variable region CDR H1"
FKFSDYYMS

SEQ ID NO: 740 - DNA, 27 bp, Artificial Sequence
  source: /note="Description of Artificial Sequence: Synthetic heavy chain variable region CDR H1"
ttcaagttcagtgactactacatgagt

SEQ ID NO: 741 - protein, 17 aa, Artificial Sequence
  source: /note="Description of Artificial Sequence: Synthetic heavy chain variable region CDR H2"
HISSSNSYINYADSVKG

SEQ ID NO: 742 - DNA, 51 bp, Artificial Sequence
  source: /note="Description of Artificial Sequence: Synthetic heavy chain variable region CDR H2"
cacattagtagtagtaatagttacataaactacgcagactctgtgaagggc

SEQ ID NO: 743 - protein, 18 aa, Artificial Sequence
  source: /note="Description of Artificial Sequence: Synthetic heavy chain variable region CDR H3"
ARFPLYCSRSSCSHYVDY

SEQ ID NO: 744 - DNA, 54 bp, Artificial Sequence
  source: /note="Description of Artificial Sequence: Synthetic heavy chain variable region CDR H3"
gcgagattccccctttactgtagtcgttcctcctgctcccattacgttgactac

SEQ ID NO: 745 - DNA, 330 bp, Artificial Sequence
  source: /note="Description of Artificial Sequence: Synthetic light chain variable region"
cagtctgtcctgactcagcctccctcagtgtctggggccccagggcagagggtcaccatctcctgcactgggagcggctccaacatcggggcaggttatgatgtacactggtaccagcagcttccaggaacagcccccaaactcctcatctatgataacaacaatcggccctcaggggtccctgaccgattctctggctccaagtctggcacctcagcctccctggccatcactgggctccaggttgaggatgaggctgattattactgccagtcctatgacaggagcctgagtgtggtattcggcggagggaccaaggtcaccgtccta

SEQ ID NO: 746 - protein, 110 aa, Artificial Sequence
  source: /note="Description of Artificial Sequence: Synthetic light chain variable region"
QSVLTQPPSVSGAPGQRVTISCTGSGSNIGAGYDVHWYQQLPGTAPKLLIYDNNNRPSGVPDRFSGSKSGTSASLAITGLQVEDEADYYCQSYDRSLSVVFGGGTKVTVL

SEQ ID NO: 747 - protein, 14 aa, Artificial Sequence
  source: /note="Description of Artificial Sequence: Synthetic light chain variable region CDR L1"
TGSGSNIGAGYDVH

SEQ ID NO: 748 - DNA, 42 bp, Artificial Sequence
  source: /note="Description of Artificial Sequence: Synthetic light chain variable region CDR L1"
actgggagcggctccaacatcggggcaggttatgatgtacac

SEQ ID NO: 749 - protein, 7 aa, Artificial Sequence
  source: /note="Description of Artificial Sequence: Synthetic light chain variable region CDR L2"
DNNNRPS

SEQ ID NO: 750 - DNA, 21 bp, Artificial Sequence
  source: /note="Description of Artificial Sequence: Synthetic light chain variable region CDR L2"
gataacaacaatcggccctca

SEQ ID NO: 751 - protein, 10 aa, Artificial Sequence
  source: /note="Description of Artificial Sequence: Synthetic light chain variable region CDR L3"
QSYDRSLSVV

SEQ ID NO: 752 - DNA, 30 bp, Artificial Sequence
  source: /note="Description of Artificial Sequence: Synthetic light chain variable region CDR L3"
cagtcctatgacaggagcctgagtgtggta

SEQ ID NO: 753 - DNA, 357 bp, Artificial Sequence
  source: /note="Description of Artificial Sequence: Synthetic heavy chain variable region"
caggtgcagctggtgcaatctggaccagaggtgaaaaagcccggggagtctctgaagatctcctgtaagggttctggatatacgtttactacctactggatcggctgggtgcgccagaggcccgggaagggcctggagtggatgggaatcatccatcccggtgactctgataccagatacagtccgtccttacaaggccaggtcaccatctcagtcgacaagtccatcaataccgcctacctgcagtggaggagtttgaaggcctcggacaccggcatgtattattgtgcgagattcgaatacggtgacttcgggaatgacttctggggccagggaaccctggtcactgtctcctca

SEQ ID NO: 754 - protein, 119 aa, Artificial Sequence
  source: /note="Description of Artificial Sequence: Synthetic heavy chain variable region"
QVQLVQSGPEVKKPGESLKISCKGSGYTFTTYWIGWVRQRPGKGLEWMGIIHPGDSDTRYSPSLQGQVTISVDKSINTAYLQWRSLKASDTGMYYCARFEYGDFGNDFWGQGTLVTVSS

SEQ ID NO: 755 - protein, 9 aa, Artificial Sequence
  source: /note="Description of Artificial Sequence: Synthetic heavy chain variable region CDR H1"
YTFTTYWIG

SEQ ID NO: 756 - DNA, 27 bp, Artificial Sequence
  source: /note="Description of Artificial Sequence: Synthetic heavy chain variable region CDR H1"
tatacgtttactacctactggatcggc

SEQ ID NO: 757 - protein, 17 aa, Artificial Sequence
  source: /note="Description of Artificial Sequence: Synthetic heavy chain variable region CDR H2"
IIHPGDSDTRYSPSLQG

SEQ ID NO: 758 - DNA, 51 bp, Artificial Sequence
  source: /note="Description of Artificial Sequence: Synthetic heavy chain variable region CDR H2"
atcatccatcccggtgactctgataccagatacagtccgtccttacaaggc

SEQ ID NO: 759 - protein, 12 aa, Artificial Sequence
  source: /note="Description of Artificial Sequence: Synthetic heavy chain variable region CDR H3"
ARFEYGDFGNDF

SEQ ID NO: 760 - DNA, 36 bp, Artificial Sequence
  source: /note="Description of Artificial Sequence: Synthetic heavy chain variable region CDR H3"
gcgagattcgaatacggtgacttcgggaatgacttc

SEQ ID NO: 761 - DNA, 333 bp, Artificial Sequence
  source: /note="Description of Artificial Sequence: Synthetic light chain variable region"
aattttatgctgactcagccccactctgtgtcggagtctccggggaagacggtaaccatctcctgctcccgcagcagtggcagcattgccaacaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggcagactactactgtcagtcttatgatagtagcaatcatagggtgttcggcggagggaccaagctcaccgtccta

SEQ ID NO: 762 - protein, 111 aa, Artificial Sequence
  source: /note="Description of Artificial Sequence: Synthetic light chain variable region"
NFMLTQPHSVSESPGKTVTISCSRSSGSIANNYVQWYQQRPGSSPTTVIYEDNQRPSGVPDRFSGSIDSSSNSASLTISGLKTEDEADYYCQSYDSSNHRVFGGGTKLTVL

SEQ ID NO: 763 - protein, 13 aa, Artificial Sequence
  source: /note="Description of Artificial Sequence: Synthetic light chain variable region CDR L1"
SRSSGSIANNYVQ

SEQ ID NO: 764 - DNA, 39 bp, Artificial Sequence
  source: /note="Description of Artificial Sequence: Synthetic light chain variable region CDR L1"
tcccgcagcagtggcagcattgccaacaactatgtgcag

SEQ ID NO: 765 - protein, 7 aa, Artificial Sequence
  source: /note="Description of Artificial Sequence: Synthetic light chain variable region CDR L2"
EDNQRPS

SEQ ID NO: 766 - DNA, 21 bp, Artificial Sequence
  source: /note="Description of Artificial Sequence: Synthetic light chain variable region CDR L2"
gaggataaccaaagaccctct

SEQ ID NO: 767 - protein, 10 aa, Artificial Sequence
  source: /note="Description of Artificial Sequence: Synthetic light chain variable region CDR L3"
QSYDSSNHRV

SEQ ID NO: 768 - DNA, 30 bp, Artificial Sequence
  source: /note="Description of Artificial Sequence: Synthetic light chain variable region CDR L3"
cagtcttatgatagtagcaatcatagggtg

SEQ ID NO: 769 - DNA, 369 bp, Artificial Sequence
  source: /note="Description of Artificial Sequence: Synthetic heavy chain variable region"
gaggtgcagctgttggagtctgggggaggcttggtacagcctggggggtccctgcgactctcctgtgcagcctctggattcacctttaggagatatgccatgacctgggtccgccaggctccagggaaggggctggagtgggtcgcagctattactgctactggtgataccacatactacccagactccgtaaagggccggttcgccgtctccagagacaattcccggaacacgctttatctgcaaatggacagtctgagagccgaggacacggccctatattactgtgcgaaaagttgggatgactacggtgacctggactggtacttcgctctctggggccgtggcaccctggtcaccgtctcctca

SEQ ID NO: 770 - protein, 123 aa, Artificial Sequence
  source: /note="Description of Artificial Sequence: Synthetic heavy chain variable region"
EVQLLESGGGLVQPGGSLRLSCAASGFTFRRYAMTWVRQAPGKGLEWVAAITATGDTTYYPDSVKGRFAVSRDNSRNTLYLQMDSLRAEDTALYYCAKSWDDYGDLDWYFALWGRGTLVTVSS

SEQ ID NO: 771 - protein, 9 aa, Artificial Sequence
  source: /note="Description of Artificial Sequence: Synthetic heavy chain variable region CDR H1"
FTFRRYAMT

SEQ ID NO: 772 - DNA, 27 bp, Artificial Sequence
  source: /note="Description of Artificial Sequence: Synthetic heavy chain variable region CDR H1"
ttcacctttaggagatatgccatgacc

SEQ ID NO: 773 - protein, 17 aa, Artificial Sequence
  source: /note="Description of Artificial Sequence: Synthetic heavy chain variable region CDR H2"
AITATGDTTYYPDSVKG

SEQ ID NO: 774 - DNA, 51 bp, Artificial Sequence
  source: /note="Description of Artificial Sequence: Synthetic heavy chain variable region CDR H2"
gctattactgctactggtgataccacatactacccagactccgtaaagggc

SEQ ID NO: 775 - protein, 16 aa, Artificial Sequence
  source: /note="Description of Artificial Sequence: Synthetic heavy chain variable region CDR H3"
AKSWDDYGDLDWYFAL

SEQ ID NO: 776 - DNA, 48 bp, Artificial Sequence
  source: /note="Description of Artificial Sequence: Synthetic heavy chain variable region CDR H3"
gcgaaaagttgggatgactacggtgacctggactggtacttcgctctc

SEQ ID NO: 777 - DNA, 324 bp, Artificial Sequence
  source: /note="Description of Artificial Sequence: Synthetic light chain variable region"
gatattgtgatgacccagtctccagccatcctgtctgtgtctccaggggaaagagccaccctctcctgcagggccagtcagagtgttagcagcagcttggcctggtaccagcagaaacctggccaggctcccaggctcctcatctacggtgcatccaccagggccactggtatcccaccccggttcagtggcagtgggtctgggacacaattcactctcaccatcagcagcctgcagtctgaagattttgcagtgtattactgtcagcagtatagtgactggcctccgctcactttcggcggggggaccaaggtggagatcaaa

SEQ ID NO: 778 - protein, 108 aa, Artificial Sequence
  source: /note="Description of Artificial Sequence: Synthetic light chain variable region"
DIVMTQSPAILSVSPGERATLSCRASQSVSSSLAWYQQKPGQAPRLLIYGASTRATGIPPRFSGSGSGTQFTLTISSLQSEDFAVYYCQQYSDWPPLTFGGGTKVEIK

SEQ ID NO: 779 - protein, 11 aa, Artificial Sequence
  source: /note="Description of Artificial Sequence: Synthetic light chain variable region CDR L1"
RASQSVSSSLA

SEQ ID NO: 780 - DNA, 33 bp, Artificial Sequence; identical to SEQ ID NO: 732
  source: /note="Description of Artificial Sequence: Synthetic light chain variable region CDR L1"

SEQ ID NO: 781 - protein, 7 aa, Artificial Sequence
  source: /note="Description of Artificial Sequence: Synthetic light chain variable region CDR L2"
GASTRAT

SEQ ID NO: 782 - DNA, 21 bp, Artificial Sequence
  source: /note="Description of Artificial Sequence: Synthetic light chain variable region CDR L2"
ggtgcatccaccagggccact

SEQ ID NO: 783 - protein, 10 aa, Artificial Sequence
  source: /note="Description of Artificial Sequence: Synthetic light chain variable region CDR L3"
QQYSDWPPLT

SEQ ID NO: 784 - DNA, 30 bp, Artificial Sequence; identical to SEQ ID NO: 736
  source: /note="Description of Artificial Sequence: Synthetic light chain variable region CDR L3"

SEQ ID NO: 785 - DNA, 369 bp, Artificial Sequence
  source: /note="Description of Artificial Sequence: Synthetic heavy chain variable region"
caggtccagcttgtacagtctgggggaggtttggtacagcctggggggtccctgagactctcctgtgcagcctctagattcacctttagcagctatgccatgagctgggtccgccaggctccagggaaggggctggagtgggtctcaactattagtggtagtggtattagcacgtactacgcagactccgtgaagggccggttcaccatctccagagacaattccaagaacacgctgtatctgcaaatgaacagcctgagcgccgaggacacggccgtatattactgtgcgaaagaattgagggagtattactatgatagcagtggctttgactactggggccagggaaccctggtcaccgtctcctca

SEQ ID NO: 786 - protein, 123 aa, Artificial Sequence
  source: /note="Description of Artificial Sequence: Synthetic heavy chain variable region"
QVQLVQSGGGLVQPGGSLRLSCAASRFTFSSYAMSWVRQAPGKGLEWVSTISGSGISTYYADSVKGRFTISRDNSKNTLYLQMNSLSAEDTAVYYCAKELREYYYDSSGFDYWGQGTLVTVSS

SEQ ID NO: 787 - protein, 9 aa, Artificial Sequence
  source: /note="Description of Artificial Sequence: Synthetic heavy chain variable region CDR H1"
FTFSSYAMS

SEQ ID NO: 788 - DNA, 27 bp, Artificial Sequence
  source: /note="Description of Artificial Sequence: Synthetic heavy chain variable region CDR H1"
ttcacctttagcagctatgccatgagc

SEQ ID NO: 789 - protein, 17 aa, Artificial Sequence
  source: /note="Description of Artificial Sequence: Synthetic heavy chain variable region CDR H2"
TISGSGISTYYADSVKG

SEQ ID NO: 790 - DNA, 51 bp, Artificial Sequence
  source: /note="Description of Artificial Sequence: Synthetic heavy chain variable region CDR H2"
actattagtggtagtggtattagcacgtactacgcagactccgtgaagggc

SEQ ID NO: 791 - protein, 16 aa, Artificial Sequence
  source: /note="Description of Artificial Sequence: Synthetic heavy chain variable region CDR H3"
AKELREYYYDSSGFDY

SEQ ID NO: 792 - DNA, 48 bp, Artificial Sequence
  source: /note="Description of Artificial Sequence: Synthetic heavy chain variable region CDR H3"
gcgaaagaattgagggagtattactatgatagcagtggctttgactac

SEQ ID NO: 793 - DNA, 330 bp, Artificial Sequence
  source: /note="Description of Artificial Sequence: Synthetic light chain variable region"
cagcctgtgctgactcagtctcgctcagtgtccgggtctcctgaacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgagtctgattattactgctgctcatatgcaggcacctacacttatgtcttcggaactgggaccaaggtcaccgtccta

SEQ ID NO: 794 - protein, 110 aa, Artificial Sequence
  source: /note="Description of Artificial Sequence: Synthetic light chain variable region"
QPVLTQSRSVSGSPEQSVTISCTGTSSDVGGYNYVSWYQQHPGKAPKLMIYDVSKRPSGVPDRFSGSKSGNTASLTISGLQAEDESDYYCCSYAGTYTYVFGTGTKVTVL

SEQ ID NO: 795 - protein, 14 aa, Artificial Sequence
  source: /note="Description of Artificial Sequence: Synthetic light chain variable region CDR L1"
TGTSSDVGGYNYVS

SEQ ID NO: 796 - DNA, 42 bp, Artificial Sequence
  source: /note="Description of Artificial Sequence: Synthetic light chain variable region CDR L1"
actggaaccagcagtgatgttggtggttataactatgtctcc

SEQ ID NO: 797 - protein, 7 aa, Artificial Sequence
  source: /note="Description of Artificial Sequence: Synthetic light chain variable region CDR L2"
DVSKRPS

SEQ ID NO: 798 - DNA, 21 bp, Artificial Sequence
  source: /note="Description of Artificial Sequence: Synthetic light chain variable region CDR L2"
gatgtcagtaagcggccctca

SEQ ID NO: 799 - protein, 10 aa, Artificial Sequence
  source: /note="Description of Artificial Sequence: Synthetic light chain variable region CDR L3"
CSYAGTYTYV

SEQ ID NO: 800 - DNA, 30 bp, Artificial Sequence
  source: /note="Description of Artificial Sequence: Synthetic light chain variable region CDR L3"
tgctcatatgcaggcacctacacttatgtc

SEQ ID NO: 801 - DNA, 381 bp, Artificial Sequence
  source: /note="Description of Artificial Sequence: Synthetic heavy chain variable region"
gaggtgcagctgttggagtctgggggaggcgtggtccagcctgggaggtccctgaaactctcctgtgcagcctctggattcagcttcactaccgatgttatgcactggatacgccaggctccaggcaaggggctggagtgggtggcagttatttcaactgatggagccaattcatactacgcagagtccgtgaagggccgattcaccatctccagagacaattccaagaacacgctgtttctgcagatgagcagcctgagagctgaggacacggctgtgtattattgtgcgagccagggatatcattatgttaatatggctgatgtgggagtgccctcgtttgaccactggggccagggaaccctggtcaccgtctcctca

SEQ ID NO: 802 - protein, 127 aa, Artificial Sequence
  source: /note="Description of Artificial Sequence: Synthetic heavy chain variable region"
EVQLLESGGGVVQPGRSLKLSCAASGFSFTTDVMHWIRQAPGKGLEWVAVISTDGANSYYAESVKGRFTISRDNSKNTLFLQMSSLRAEDTAVYYCASQGYHYVNMADVGVPSFDHWGQGTLVTVSS

SEQ ID NO: 803 - protein, 9 aa, Artificial Sequence
  source: /note="Description of Artificial Sequence: Synthetic heavy chain variable region CDR H1"
FSFTTDVMH

SEQ ID NO: 804 - DNA, 27 bp, Artificial Sequence
  source: /note="Description of Artificial Sequence: Synthetic heavy chain variable region CDR H1"
ttcagcttcactaccgatgttatgcac

SEQ ID NO: 805 - protein, 17 aa, Artificial Sequence
  source: /note="Description of Artificial Sequence: Synthetic heavy chain variable region CDR H2"
VISTDGANSYYAESVKG

SEQ ID NO: 806 - DNA, 51 bp, Artificial Sequence
  source: /note="Description of Artificial Sequence: Synthetic heavy chain variable region CDR H2"
gttatttcaactgatggagccaattcatactacgcagagtccgtgaagggc

SEQ ID NO: 807 - protein, 20 aa, Artificial Sequence
  source: /note="Description of Artificial Sequence: Synthetic heavy chain variable region CDR H3"
ASQGYHYVNMADVGVPSFDH

SEQ ID NO: 808 - DNA, 60 bp, Artificial Sequence
  source: /note="Description of Artificial Sequence: Synthetic heavy chain variable region CDR H3"
gcgagccagggatatcattatgttaatatggctgatgtgggagtgccctcgtttgaccac

SEQ ID NO: 809 - DNA, 321 bp, Artificial Sequence
  source: /note="Description of Artificial Sequence: Synthetic light chain variable region"
gaaacgacactcacgcagtctccatcctccctgtctgcatctgtcggagacagagtcaccatcacttgccgggcacgtcggagcattgacaactatttaaattggtatcagcacaaaccagggacagcccctaagctcctgatctatgctgtatccagtttgcctagcggggtcccatcgagattcagtggcagtggatctggggcagacttcactctcaccatcagcagtctgcaacctgaagatcttgcaacttactactgtcaacagagttacatgacccctcccacttttggccaggggaccaagctggagatcaaa

SEQ ID NO: 810 - protein, 107 aa, Artificial Sequence
  source: /note="Description of Artificial Sequence: Synthetic light chain variable region"
ETTLTQSPSSLSASVGDRVTITCRARRSIDNYLNWYQHKPGTAPKLLIYAVSSLPSGVPSRFSGSGSGADFTLTISSLQPEDLATYYCQQSYMTPPTFGQGTKLEIK

SEQ ID NO: 811 - protein, 11 aa, Artificial Sequence
  source: /note="Description of Artificial Sequence: Synthetic light chain variable region CDR L1"
RARRSIDNYLN

SEQ ID NO: 812 - DNA, 33 bp, Artificial Sequence
  source: /note="Description of Artificial Sequence: Synthetic light chain variable region CDR L1"
cgggcacgtcggagcattgacaactatttaaat

SEQ ID NO: 813 - protein, 7 aa, Artificial Sequence
  source: /note="Description of Artificial Sequence: Synthetic light chain variable region CDR L2"
AVSSLPS

SEQ ID NO: 814 - DNA, 21 bp, Artificial Sequence
  source: /note="Description of Artificial Sequence: Synthetic light chain variable region CDR L2"
gctgtatccagtttgcctagc

SEQ ID NO: 815 - protein, 9 aa, Artificial Sequence
  source: /note="Description of Artificial Sequence: Synthetic light chain variable region CDR L3"
QQSYMTPPT

SEQ ID NO: 816 - DNA, 27 bp, Artificial Sequence
  source: /note="Description of Artificial Sequence: Synthetic light chain variable region CDR L3"
caacagagttacatgacccctcccact

SEQ ID NO: 817 - DNA, 372 bp, Artificial Sequence
  source: /note="Description of Artificial Sequence: Synthetic heavy chain variable region"
gaggtgcagctgttggagtctggggctgaggtgaagaagcctgggtcctcggtgaaggtctcctgcaaggcttctggcggcaccttcagcagctatgctataacctgggtgcgacaggcccctggacaaggacttgagtggatgggagggatcatccctatccttggaacaacaacctacgcacagaggttccagggcagagtcacgattaccgcggacaaatccacgacaacagcctacatggagctgagtcgcctgagatctgaggacacggccgtctattactgtgcgaaaacggtgtcacaatatcccaacacctacaactacggcatggacgtctggggccaagggaccacggtcaccgtctcctca

SEQ ID NO: 818 - protein, 124 aa, Artificial Sequence
  source: /note="Description of Artificial Sequence: Synthetic heavy chain variable region"
EVQLLESGAEVKKPGSSVKVSCKASGGTFSSYAITWVRQAPGQGLEWMGGIIPILGTTTYAQRFQGRVTITADKSTTTAYMELSRLRSEDTAVYYCAKTVSQYPNTYNYGMDVWGQGTTVTVSS

SEQ ID NO: 819 - protein, 9 aa, Artificial Sequence
  source: /note="Description of Artificial Sequence: Synthetic heavy chain variable region CDR H1"
GTFSSYAIT

SEQ ID NO: 820 - DNA, 27 bp, Artificial Sequence
  source: /note="Description of Artificial Sequence: Synthetic heavy chain variable region CDR H1"
ggcaccttcagcagctatgctataacc

SEQ ID NO: 821 - protein, 17 aa, Artificial Sequence
  source: /note="Description of Artificial Sequence: Synthetic heavy chain variable region CDR H2"
GIIPILGTTTYAQRFQG

SEQ ID NO: 822 - DNA, 51 bp, Artificial Sequence
  source: /note="Description of Artificial Sequence: Synthetic heavy chain variable region CDR H2"
gggatcatccctatccttggaacaacaacctacgcacagaggttccagggc

SEQ ID NO: 823 - protein, 17 aa, Artificial Sequence
  source: /note="Description of Artificial Sequence: Synthetic heavy chain variable region CDR H3"
AKTVSQYPNTYNYGMDV

SEQ ID NO: 824 - DNA, 51 bp, Artificial Sequence
  source: /note="Description of Artificial Sequence: Synthetic heavy chain variable region CDR H3"
gcgaaaacggtgtcacaatatcccaacacctacaactacggcatggacgtc

SEQ ID NO: 825 - DNA, 321 bp, Artificial Sequence
  source: /note="Description of Artificial Sequence: Synthetic light chain variable region"
gaaattgtgatgacacagtctccctcctccctgtctgcatctgtaggagacagagtcaccatcacttgccgggcaagtcagagcgttagcatctatttaaactggtatcagcagaaaccagggaaaacccctgagctcctgatctatggtgcatcccgtttgcaaagtggggtcccatcaaggttcagtggcagtggatctgggacagatttcactctcaccatcagcagtctgcaacctgaagattttgcaacttactactgtctacagacgtactctacccccctcaccttcggccaagggaccaaggtggaaatcaaa

SEQ ID NO: 826 - protein, 107 aa, Artificial Sequence
  source: /note="Description of Artificial Sequence: Synthetic light chain variable region"
EIVMTQSPSSLSASVGDRVTITCRASQSVSIYLNWYQQKPGKTPELLIYGASRLQSGVPSRFSGSGSGTDFTLTISSLQPEDFATYYCLQTYSTPLTFGQGTKVEIK

SEQ ID NO: 827 - protein, 11 aa, Artificial Sequence
  source: /note="Description of Artificial Sequence: Synthetic light chain variable region CDR L1"
RASQSVSIYLN

SEQ ID NO: 828 - DNA, 33 bp, Artificial Sequence
  source: /note="Description of Artificial Sequence: Synthetic light chain variable region CDR L1"
cgggcaagtcagagcgttagcatctatttaaac

SEQ ID NO: 829 - protein, 7 aa, Artificial Sequence
  source: /note="Description of Artificial Sequence: Synthetic light chain variable region CDR L2"
GASRLQS

SEQ ID NO: 830 - DNA, 21 bp, Artificial Sequence
  source: /note="Description of Artificial Sequence: Synthetic light chain variable region CDR L2"
ggtgcatcccgtttgcaaagt

SEQ ID NO: 831 - protein, 9 aa, Artificial Sequence
  source: /note="Description of Artificial Sequence: Synthetic light chain variable region CDR L3"
LQTYSTPLT

SEQ ID NO: 832 - DNA, 27 bp, Artificial Sequence
  source: /note="Description of Artificial Sequence: Synthetic light chain variable region CDR L3"
ctacagacgtactctacccccctcacc

SEQ ID NO: 833 - DNA, 390 bp, Artificial Sequence
  source: /note="Description of Artificial Sequence: Synthetic heavy chain variable region"
caggtgcagctggtggagtctggggctgaggtgaagaagcctgggtcctcggtgaaggtctcctgcaaggcttctggaggcaccttcggcagggattctatcagctgggtgcgacaggcccctgggcagggccttgagtggatgggagggatcaaccctatctttcatacatcacactacgcacagaaattccagggcagagtcacaattaccgcggacgagtccacgagcacagcctacatggaactgggcaacctgagatctgaggacacggccatgtattactgtgcgagagttccccccccccggggtcattgtgagagtaccagctgtttatgggggacctattttgccttctggggccagggaaccctggtcaccgtctcctca

SEQ ID NO: 834 - protein, 130 aa, Artificial Sequence
  source: /note="Description of Artificial Sequence: Synthetic heavy chain variable region"
QVQLVESGAEVKKPGSSVKVSCKASGGTFGRDSISWVRQAPGQGLEWMGGINPIFHTSHYAQKFQGRVTITADESTSTAYMELGNLRSEDTAMYYCARVPPPRGHCESTSCLWGTYFAFWGQGTLVTVSS

SEQ ID NO: 835 - protein, 9 aa, Artificial Sequence
  source: /note="Description of Artificial Sequence: Synthetic heavy chain variable region CDR H1"
GTFGRDSIS

SEQ ID NO: 836 - DNA, 27 bp, Artificial Sequence
  source: /note="Description of Artificial Sequence: Synthetic heavy chain variable region CDR H1"
ggcaccttcggcagggattctatcagc

SEQ ID NO: 837 - protein, 17 aa, Artificial Sequence
  source: /note="Description of Artificial Sequence: Synthetic heavy chain variable region CDR H2"
GINPIFHTSHYAQKFQG

SEQ ID NO: 838 - DNA, 51 bp, Artificial Sequence
  source: /note="Description of Artificial Sequence: Synthetic heavy chain variable region CDR H2"
gggatcaaccctatctttcatacatcacactacgcacagaaattccagggc

SEQ ID NO: 839 - protein, 23 aa, Artificial Sequence
  source: /note="Description of Artificial Sequence: Synthetic heavy chain variable region CDR H3"
ARVPPPRGHCESTSCLWGTYFAF

SEQ ID NO: 840 - DNA, 69 bp, Artificial Sequence
  source: /note="Description of Artificial Sequence: Synthetic heavy chain variable region CDR H3"
gcgagagttccccccccccggggtcattgtgagagtaccagctgtttatgggggacctattttgccttc

SEQ ID NO: 841 - DNA, 327 bp, Artificial Sequence
  source: /note="Description of Artificial Sequence: Synthetic light chain variable region"
gaaacgacactcacgcagtctccagccaccctgtctttgtctccaggggaaagagccaccctctcctgcagggccagtcagagggttcgcagctacttagcctggtaccagcagaaacctggccaggctcccaggctcctcatctatgatgcatccatcagggctactggcatcccagccaggttcagtggcagtgggtctggggcagacttcactctcaccatcagcagcctcgagcctgaagattttgcagtttattactgtcagctgcgtgactactggcctcccacgtggacgttcggccaagggaccaaggtggaaatcaaa

SEQ ID NO: 842 - protein, 109 aa, Artificial Sequence
  source: /note="Description of Artificial Sequence: Synthetic light chain variable region"
ETTLTQSPATLSLSPGERATLSCRASQRVRSYLAWYQQKPGQAPRLLIYDASIRATGIPARFSGSGSGADFTLTISSLEPEDFAVYYCQLRDYWPPTWTFGQGTKVEIK

SEQ ID NO: 843 - protein, 11 aa, Artificial Sequence
  source: /note="Description of Artificial Sequence: Synthetic light chain variable region CDR L1"
RASQRVRSYLA

SEQ ID NO: 844 - DNA, 33 bp, Artificial Sequence
  source: /note="Description of Artificial Sequence: Synthetic light chain variable region CDR L1"
agggccagtcagagggttcgcagctacttagcc

SEQ ID NO: 845 - protein, 7 aa, Artificial Sequence
  source: /note="Description of Artificial Sequence: Synthetic light chain variable region CDR L2"
DASIRAT

SEQ ID NO: 846 - DNA, 21 bp, Artificial Sequence
  source: /note="Description of Artificial Sequence: Synthetic light chain variable region CDR L2"
gatgcatccatcagggctact

SEQ ID NO: 847 - protein, 11 aa, Artificial Sequence
  source: /note="Description of Artificial Sequence: Synthetic light chain variable region CDR L3"
QLRDYWPPTWT

SEQ ID NO: 848 - DNA, 33 bp, Artificial Sequence
  source: /note="Description of Artificial Sequence: Synthetic light chain variable region CDR L3"
cagctgcgtgactactggcctcccacgtggacg

SEQ ID NO: 849 - DNA, 366 bp, Artificial Sequence
  source: /note="Description of Artificial Sequence: Synthetic heavy chain variable region"
gaggtgcagctgttggagtctgggggagacctggtacagccgggggggtccctgagactctcctgtgcagcctctggattccccttcagcagccatagcatgaactgggtccgccaggctccagggaagggcctggagtggatctcatacattagtggtggtagtgataccattcagtacgcagactctgtgaagggccgatttaccatctccagagacaatgtcaagaattcactgtatctgcaaatgaacagcctgagagccgaggacacggctgtctattactgtgcgagagaccagtatatttggaactatgtggaacctcttgactactggggccagggaaccctggtcaccgtctcctca

SEQ ID NO: 850 - protein, 122 aa, Artificial Sequence
  source: /note="Description of Artificial Sequence: Synthetic heavy chain variable region"
EVQLLESGGDLVQPGGSLRLSCAASGFPFSSHSMNWVRQAPGKGLEWISYISGGSDTIQYADSVKGRFTISRDNVKNSLYLQMNSLRAEDTAVYYCARDQYIWNYVEPLDYWGQGTLVTVSS

SEQ ID NO: 851 - protein, 9 aa, Artificial Sequence
  source: /note="Description of Artificial Sequence: Synthetic heavy chain variable region CDR H1"
FPFSSHSMN

SEQ ID NO: 852 - DNA, 27 bp, Artificial Sequence
  source: /note="Description of Artificial Sequence: Synthetic heavy chain variable region CDR H1"
ttccccttcagcagccatagcatgaac

SEQ ID NO: 853 - protein, 17 aa, Artificial Sequence
  source: /note="Description of Artificial Sequence: Synthetic heavy chain variable region CDR H2"
YISGGSDTIQYADSVKG

SEQ ID NO: 854 - DNA, 51 bp, Artificial Sequence
  source: /note="Description of Artificial Sequence: Synthetic heavy chain variable region CDR H2"
tacattagtggtggtagtgataccattcagtacgcagactctgtgaagggc

SEQ ID NO: 855 - protein, 15 aa, Artificial Sequence
  source: /note="Description of Artificial Sequence: Synthetic heavy chain variable region CDR H3"
ARDQYIWNYVEPLDY

SEQ ID NO: 856 - DNA, 45 bp, Artificial Sequence
  source: /note="Description of Artificial Sequence: Synthetic heavy chain variable region CDR H3"
gcgagagaccagtatatttggaactatgtggaacctcttgactac

SEQ ID NO: 857 - DNA, 321 bp, Artificial Sequence
  source: /note="Description of Artificial Sequence: Synthetic light chain variable region"
gacatccagatgacccagtctccatcctccctgtctgcatctgtaggagacagagtcaccatcacttgccgggcaagtcaggacattagctattatttaggctggtatcagcagaaagcagggaaagccccgaagctcctgatttatgctgtatccaatttgcaaactggggtcccatcaaggttcagcggcagtggatctggcacagatttcactctcaccatcagcagcctgcagcctgaagatttcgcaacttattattgtctacaagatcacacttgcccttggacgttcggccaagggaccaaggtggaaatcaaa

SEQ ID NO: 858 - protein, 107 aa, Artificial Sequence
  source: /note="Description of Artificial Sequence: Synthetic light chain variable region"
DIQMTQSPSSLSASVGDRVTITCRASQDISYYLGWYQQKAGKAPKLLIYAVSNLQTGVPSRFSGSGSGTDFTLTISSLQPEDFATYYCLQDHTCPWTFGQGTKVEIK

SEQ ID NO: 859 - protein, 11 aa, Artificial Sequence
  source: /note="Description of Artificial Sequence: Synthetic light chain variable region CDR L1"
RASQDISYYLG

SEQ ID NO: 860 - DNA, 33 bp, Artificial Sequence
  source: /note="Description of Artificial Sequence: Synthetic light chain variable region CDR L1"
cgggcaagtcaggacattagctattatttaggc

SEQ ID NO: 861 - protein, 7 aa, Artificial Sequence
  source: /note="Description of Artificial Sequence: Synthetic light chain variable region CDR L2"
AVSNLQT

SEQ ID NO: 862 - DNA, 21 bp, Artificial Sequence
  source: /note="Description of Artificial Sequence: Synthetic light chain variable region CDR L2"
gctgtatccaatttgcaaact

SEQ ID NO: 863 - protein, 9 aa, Artificial Sequence
  source: /note="Description of Artificial Sequence: Synthetic light chain variable region CDR L3"
LQDHTCPWT

SEQ ID NO: 864 - DNA, 27 bp, Artificial Sequence
  source: /note="Description of Artificial Sequence: Synthetic light chain variable region CDR L3"
ctacaagatcacacttgcccttggacg

SEQ ID NO: 865 - DNA, 366 bp, Artificial Sequence
  source: /note="Description of Artificial Sequence: Synthetic heavy chain variable region"
gaggtgcagctggtggagtctggggctgaggtgaagaagcctgggtcctcggtgaaagtctcctgcaaggtttctggaggcaccttcagcacttatggtatcagctggatacaacaggcccctggacaagggcttgagtgggtgggagggatcatccctatgtttgggacagcaaactacgcacagaggtttcagggcagagtcacccttaccgcggacgaaggcacgaacacagcttacatggagctgaacaacctgagatctgaggacacggccatgtattactgtgcgagagatcgaggtaataacggccgctactacgctatggacgtctggggccaggggaccacggtcaccgtctcctca

SEQ ID NO: 866 - protein, 122 aa, Artificial Sequence
  source: /note="Description of Artificial Sequence: Synthetic heavy chain variable region"
EVQLVESGAEVKKPGSSVKVSCKVSGGTFSTYGISWIQQAPGQGLEWVGGIIPMFGTANYAQRFQGRVTLTADEGTNTAYMELNNLRSEDTAMYYCARDRGNNGRYYAMDVWGQGTTVTVSS

SEQ ID NO: 867 - protein, 9 aa, Artificial Sequence
  source: /note="Description of Artificial Sequence: Synthetic heavy chain variable region CDR H1"
GTFSTYGIS

SEQ ID NO: 868 - DNA, 27 bp, Artificial Sequence
  source: /note="Description of Artificial Sequence: Synthetic heavy chain variable region CDR H1"
ggcaccttcagcacttatggtatcagc

SEQ ID NO: 869 - protein, 17 aa, Artificial Sequence
  source: /note="Description of Artificial Sequence: Synthetic heavy chain variable region CDR H2"
GIIPMFGTANYAQRFQG

SEQ ID NO: 870 - DNA, 51 bp, Artificial Sequence
  source: /note="Description of Artificial Sequence: Synthetic heavy chain variable region CDR H2"
gggatcatccctatgtttgggacagcaaactacgcacagaggtttcagggc

SEQ ID NO: 871 - protein, 15 aa, Artificial Sequence
  source: /note="Description of Artificial Sequence: Synthetic heavy chain variable region CDR H3"
ARDRGNNGRYYAMDV

SEQ ID NO: 872 - DNA, 45 bp, Artificial Sequence
  source: /note="Description of Artificial Sequence: Synthetic heavy chain variable region CDR H3"
gcgagagatcgaggtaataacggccgctactacgctatggacgtc

SEQ ID NO: 873 - DNA, 321 bp, Artificial Sequence
  source: /note="Description of Artificial Sequence: Synthetic light chain variable region"
gatattgtgctgacccagactccagccaccctgtctttgtctccaggggaaagagccaccctctcctgcagggccagtcagagtgtcaccacctacttagcgtggtaccaacagaaacctggccaggctcccaggctcctcatctatgatacatccaacagggccactggcatcccagccaggttcagtggcagtgggtctgggacagacttcactctcaccatcagcagcctagagcctgaagattttgcagtttattactgtcagcagcgtaacaactggccgccgaccttcggccaagggacacgactggagattaaa

SEQ ID NO: 874 - protein, 107 aa, Artificial Sequence
  source: /note="Description of Artificial Sequence: Synthetic light chain variable region"
DIVLTQTPATLSLSPGERATLSCRASQSVTTYLAWYQQKPGQAPRLLIYDTSNRATGIPARFSGSGSGTDFTLTISSLEPEDFAVYYCQQRNNWPPTFGQGTRLEIK

SEQ ID NO: 875 - protein, 11 aa, Artificial Sequence
  source: /note="Description of Artificial Sequence: Synthetic light chain variable region CDR L1"
RASQSVTTYLA

SEQ ID NO: 876 - DNA, 33 bp, Artificial Sequence
  source: /note="Description of Artificial Sequence: Synthetic light chain variable region CDR L1"
agggccagtcagagtgtcaccacctacttagcg

SEQ ID NO: 877 - protein, 7 aa, Artificial Sequence
  source: /note="Description of Artificial Sequence: Synthetic light chain variable region CDR L2"
DTSNRAT

SEQ ID NO: 878 - DNA, 21 bp, Artificial Sequence
  source: /note="Description of Artificial Sequence: Synthetic light chain variable region CDR L2"
gatacatccaacagggccact

SEQ ID NO: 879 - protein, 9 aa, Artificial Sequence
  source: /note="Description of Artificial Sequence: Synthetic light chain variable region CDR L3"
QQRNNWPPT

SEQ ID NO: 880 - DNA, 27 bp, Artificial Sequence
  source: /note="Description of Artificial Sequence: Synthetic light chain variable region CDR L3"
cagcagcgtaacaactggccgccgacc

SEQ ID NO: 881 - DNA, 357 bp, Artificial Sequence
  source: /note="Description of Artificial Sequence: Synthetic heavy chain variable region"
gaggtgcagctgttggagtctgggggaggcctggtcaagcctggggggtccctgagactctcctgtgcagcctcgggattcaccatcagtggttataacatgttctgggtccgccagcctccggggaaggggctggagtgggtctcatccattactgctggtagtagttatttaaactatgcagactcagtgaagggccgtttcatcgtctccagagacaacgccaagaattcactgtatctgcaaatgaacagcctgagagccgaggacacggctgtttatttctgtgcgagagcacctcttttacccgctatgatggacctctggggccaagggaccacggtcaccgtctcctca

SEQ ID NO: 882 - protein, 119 aa, Artificial Sequence
  source: /note="Description of Artificial Sequence: Synthetic heavy chain variable region"
EVQLLESGGGLVKPGGSLRLSCAASGFTISGYNMFWVRQPPGKGLEWVSSITAGSSYLNYADSVKGRFIVSRDNAKNSLYLQMNSLRAEDTAVYFCARAPLLPAMMDLWGQGTTVTVSS

SEQ ID NO: 883 - protein, 9 aa, Artificial Sequence
  source: /note="Description of Artificial Sequence: Synthetic heavy chain variable region CDR H1"
FTISGYNMF

SEQ ID NO: 884 - DNA, 27 bp, Artificial Sequence
  source: /note="Description of Artificial Sequence: Synthetic heavy chain variable region CDR H1"
ttcaccatcagtggttataacatgttc

SEQ ID NO: 885 - protein, 17 aa, Artificial Sequence
  source: /note="Description of Artificial Sequence: Synthetic heavy chain variable region CDR H2"
SITAGSSYLNYADSVKG

SEQ ID NO: 886 - DNA, 51 bp, Artificial Sequence; identical to SEQ ID NO: 326
  source: /note="Description of Artificial Sequence: Synthetic heavy chain variable region CDR H2"

SEQ ID NO: 887 - protein, 12 aa, Artificial Sequence
  source: /note="Description of Artificial Sequence: Synthetic heavy chain variable region CDR H3"
ARAPLLPAMMDL

SEQ ID NO: 888 - DNA, 36 bp, Artificial Sequence; identical to SEQ ID NO: 328
  source: /note="Description of Artificial Sequence: Synthetic heavy chain variable region CDR H3"

SEQ ID NO: 889 - DNA, 333 bp, Artificial Sequence; identical to SEQ ID NO: 329
  source: /note="Description of Artificial Sequence: Synthetic light chain variable region"

SEQ ID NO: 890 - protein, 111 aa, Artificial Sequence; identical to SEQ ID NO: 330
  source: /note="Description of Artificial Sequence: Synthetic light chain variable region"

SEQ ID NO: 891 - protein, 14 aa, Artificial Sequence
  source: /note="Description of Artificial Sequence: Synthetic light chain variable region CDR L1"
TGSSSNIGAGYDVH

SEQ ID NO: 892 - DNA, 42 bp, Artificial Sequence; identical to SEQ ID NO: 60
  source: /note="Description of Artificial Sequence: Synthetic light chain variable region CDR L1"

SEQ ID NO: 893 - protein, 7 aa, Artificial Sequence
  source: /note="Description of Artificial Sequence: Synthetic light chain variable region CDR L2"
TNNNRPS

SEQ ID NO: 894 - DNA, 21 bp, Artificial Sequence
  source: /note="Description of Artificial Sequence: Synthetic light chain variable region CDR L2"
actaacaacaatcggccctca

SEQ ID NO: 895 - protein, 11 aa, Artificial Sequence
  source: /note="Description of Artificial Sequence: Synthetic light chain variable region CDR L3"
QSYDRSLNGYV

SEQ ID NO: 896 - DNA, 33 bp, Artificial Sequence; identical to SEQ ID NO: 336
  source: /note="Description of Artificial Sequence: Synthetic light chain variable region CDR L3"

SEQ ID NO: 897 - DNA, 372 bp, Artificial Sequence
  source: /note="Description of Artificial Sequence: Synthetic heavy chain variable region"
gaggtgcagctggtggagactgggggaggcctggtcaagcctggggggtccctgagactctcctgtgcaggctctggattcaccttcagtagctataccctgaactgggtccgccaggctccagggaaggggctggagtgggtctcatctattagtagtagtagtacttacatatactacgcagactcagtgaagggccgattcaccatctccagagacaacgccaagaactcactgcatctgcaaatgaacagcctgagagccgaggacacggctgtgtattattgtgcgagagctgactatgatagaagtgtttatcacctcaattggctcgacccctggggccagggaaccctggtcaccgtctcctca

SEQ ID NO: 898 - protein, 124 aa, Artificial Sequence
  source: /note="Description of Artificial Sequence: Synthetic heavy chain variable region"
EVQLVETGGGLVKPGGSLRLSCAGSGFTFSSYTLNWVRQAPGKGLEWVSSISSSSTYIYYADSVKGRFTISRDNAKNSLHLQMNSLRAEDTAVYYCARADYDRSVYHLNWLDPWGQGTLVTVSS

SEQ ID NO: 899 - protein, 9 aa, Artificial Sequence
  source: /note="Description of Artificial Sequence: Synthetic heavy chain variable region CDR H1"
FTFSSYTLN

SEQ ID NO: 900 - DNA, 27 bp, Artificial Sequence
  source: /note="Description of Artificial Sequence: Synthetic heavy chain variable region CDR H1"
ttcaccttcagtagctataccctgaac

SEQ ID NO: 901 - protein, 17 aa, Artificial Sequence
  source: /note="Description of Artificial Sequence: Synthetic heavy chain variable region CDR H2"
SISSSSTYIYYADSVKG

SEQ ID NO: 902 - DNA, 51 bp, Artificial Sequence
  source: /note="Description of Artificial Sequence: Synthetic heavy chain variable region CDR H2"
tctattagtagtagtagtacttacatatactacgcagactcagtgaagggc

SEQ ID NO: 903 - protein, 17 aa, Artificial Sequence
  source: /note="Description of Artificial Sequence: Synthetic heavy chain variable region CDR H3"
ARADYDRSVYHLNWLDP

SEQ ID NO: 904 - DNA, 51 bp, Artificial Sequence
  source: /note="Description of Artificial Sequence: Synthetic heavy chain variable region CDR H3"
gcgagagctgactatgatagaagtgtttatcacctcaattggctcgacccc

SEQ ID NO: 905 - DNA, 336 bp, Artificial Sequence
  source: /note="Description of Artificial Sequence: Synthetic light chain variable region"
cagcctgtgctgactcagccgccctcagtgtctggggccccagggcagagggtcaccatctcctgcactgggagcagctccaacatcggggcaggttatgatgtacactggtaccagcaacttccaggagcagcccccaaactcctcatctatggtaacaccaatcggccctcaggggtccctgaccgattttctggctccaagtctggcacctcagcctccctggccatcactgggctccaggctgacgatgaggctgattattactgccagtcctatgacagcagcctgagtggcacttgggtgttcggcggagggaccaagctcaccgtccta

SEQ ID NO: 906 - protein, 112 aa, Artificial Sequence
  source: /note="Description of Artificial Sequence: Synthetic light chain variable region"
QPVLTQPPSVSGAPGQRVTISCTGSSSNIGAGYDVHWYQQLPGAAPKLLIYGNTNRPSGVPDRFSGSKSGTSASLAITGLQADDEADYYCQSYDSSLSGTWVFGGGTKLTVL

SEQ ID NO: 907 - protein, 14 aa, Artificial Sequence
  source: /note="Description of Artificial Sequence: Synthetic light chain variable region CDR L1"
TGSSSNIGAGYDVH

SEQ ID NO: 908 - DNA, 42 bp, Artificial Sequence; identical to SEQ ID NO: 60
  source: /note="Description of Artificial Sequence: Synthetic light chain variable region CDR L1"

SEQ ID NO: 909 - protein, 7 aa, Artificial Sequence
  source: /note="Description of Artificial Sequence: Synthetic light chain variable region CDR L2"
GNTNRPS

SEQ ID NO: 910 - DNA, 21 bp, Artificial Sequence
  source: /note="Description of Artificial Sequence: Synthetic light chain variable region CDR L2"
ggtaacaccaatcggccctca

SEQ ID NO: 911 - protein, 12 aa, Artificial Sequence
  source: /note="Description of Artificial Sequence: Synthetic light chain variable region CDR L3"
QSYDSSLSGTWV

SEQ ID NO: 912 - DNA, 36 bp, Artificial Sequence; identical to SEQ ID NO: 656
  source: /note="Description of Artificial Sequence: Synthetic light chain variable region CDR L3"

SEQ ID NO: 913 - DNA, 363 bp, Artificial Sequence
  source: /note="Description of Artificial Sequence: Synthetic heavy chain variable region"
caggtgcagctggtgcagtctgggggaggcttggtcaagcctggagggtccctgagactctcctgtgcagcctctggattcaccttcagtgaccactacatgacctggatccgccaggctccagggaaggggctggagtgggtttcatacattagcagtactagtagtttcacaaactacgcagactctgtgaagggccgattcaccatctccagagacaacgccaagaagtcactttatctgcaaatgaacagcctgagagccgaggacacggctgtgtattactgtgcgagagaccgcaattggggatatgcctatggttctgactactggggccagggaaccctggtcaccgtctcctca

SEQ ID NO: 914 - protein, 121 aa, Artificial Sequence
  source: /note="Description of Artificial Sequence: Synthetic heavy chain variable region"
QVQLVQSGGGLVKPGGSLRLSCAASGFTFSDHYMTWIRQAPGKGLEWVSYISSTSSFTNYADSVKGRFTISRDNAKKSLYLQMNSLRAEDTAVYYCARDRNWGYAYGSDYWGQGTLVTVSS

SEQ ID NO: 915 - protein, 9 aa, Artificial Sequence
  source: /note="Description of Artificial Sequence: Synthetic heavy chain variable region CDR H1"
FTFSDHYMT

SEQ ID NO: 916 - DNA, 27 bp, Artificial Sequence
  source: /note="Description of Artificial Sequence: Synthetic heavy chain variable region CDR H1"
ttcaccttcagtgaccactacatgacc

SEQ ID NO: 917 - protein, 17 aa, Artificial Sequence
  source: /note="Description of Artificial Sequence: Synthetic heavy chain variable region CDR H2"
YISSTSSFTNYADSVKG

SEQ ID NO: 918 - DNA, 51 bp, Artificial Sequence
  source: /note="Description of Artificial Sequence: Synthetic heavy chain variable region CDR H2"
tacattagcagtactagtagtttcacaaactacgcagactctgtgaagggc

SEQ ID NO: 919 - protein, 14 aa, Artificial Sequence
  source: /note="Description of Artificial Sequence: Synthetic heavy chain variable region CDR H3"
ARDRNWGYAYGSDY

SEQ ID NO: 920 - DNA, 42 bp, Artificial Sequence
  source: /note="Description of Artificial Sequence: Synthetic heavy chain variable region CDR H3"
gcgagagaccgcaattggggatatgcctatggttctgactac

SEQ ID NO: 921 - DNA, 321 bp, Artificial Sequence
  source: /note="Description of Artificial Sequence: Synthetic light chain variable region"
gacatccggttgacccagtctccagacaccctgtctttgtctccaggggaaagagccaccctctcctgcagggccagtcagagtgttagcagcacctacttagcctggtaccagcagaaacctggccaggctcccaggctcctcatttatggtgcattcggcagggccactggcatcccagacaggttcagtggcagtgggtctgggacagacttcactctcaccatcagcagactggagcctgaagattttgcagtgtattactgtcagctgtatggtaactcacggacgttcggccaagggaccaagctggagatcaaa

SEQ ID NO: 922 - protein, 107 aa, Artificial Sequence
  source: /note="Description of Artificial Sequence: Synthetic light chain variable region"
DIRLTQSPDTLSLSPGERATLSCRASQSVSSTYLAWYQQKPGQAPRLLIYGAFGRATGIPDRFSGSGSGTDFTLTISRLEPEDFAVYYCQLYGNSRTFGQGTKLEIK

SEQ ID NO: 923 - protein, 12 aa, Artificial Sequence
  source: /note="Description of Artificial Sequence: Synthetic light chain variable region CDR L1"
RASQSVSSTYLA

SEQ ID NO: 924 - DNA, 36 bp, Artificial Sequence
  source: /note="Description of Artificial Sequence: Synthetic light chain variable region CDR L1"
agggccagtcagagtgttagcagcacctacttagcc

SEQ ID NO: 925 - protein, 7 aa, Artificial Sequence
  source: /note="Description of Artificial Sequence: Synthetic light chain variable region CDR L2"
GAFGRAT

SEQ ID NO: 926 - DNA, 21 bp, Artificial Sequence
  source: /note="Description of Artificial Sequence: Synthetic light chain variable region CDR L2"
ggtgcattcggcagggccact

SEQ ID NO: 927 - protein, 8 aa, Artificial Sequence
  source: /note="Description of Artificial Sequence: Synthetic light chain variable region CDR L3"
QLYGNSRT

SEQ ID NO: 928 - DNA, 24 bp, Artificial Sequence
  source: /note="Description of Artificial Sequence: Synthetic light chain variable region CDR L3"
cagctgtatggtaactcacggacg

SEQ ID NO: 929 - DNA, 411 bp, Artificial Sequence
  source: /note="Description of Artificial Sequence: Synthetic heavy chain variable region"
gaggtgcagctggtggagtctgggggaggcttggtacagcctggggggtccctgagaatctcctgtgcagcctctggattctccattagtagtcatgccgtgagctgggtccgccaggctccagggaaggggctggagtgggtctcagttattagtgggagtggtggtgacacacactccgtagttcaaggtcgtggtagtggcacatattacgcagactccgtgaagggccggttcaccatctccagagacaatgtcaggaacacagtgtatctgcaaatgaatagcctgagggtcgaggacacggccgtatattattgtgcgaaagacgaccccacgcttttttggagtggttcggggtactacggaatggacgtctggggccaagggaccacggtcaccgtctcctca

SEQ ID NO: 930 - protein, 137 aa, Artificial Sequence
  source: /note="Description of Artificial Sequence: Synthetic heavy chain variable region"
EVQLVESGGGLVQPGGSLRISCAASGFSISSHAVSWVRQAPGKGLEWVSVISGSGGDTHSVVQGRGSGTYYADSVKGRFTISRDNVRNTVYLQMNSLRVEDTAVYYCAKDDPTLFWSGSGYYGMDVWGQGTTVTVSS

SEQ ID NO: 931 - protein, 9 aa, Artificial Sequence
  source: /note="Description of Artificial Sequence: Synthetic heavy chain variable region CDR H1"
FSISSHAVS

SEQ ID NO: 932 - DNA, 27 bp, Artificial Sequence
  source: /note="Description of Artificial Sequence: Synthetic heavy chain variable region CDR H1"
ttctccattagtagtcatgccgtgagc

SEQ ID NO: 933 - protein, 28 aa, Artificial Sequence
  source: /note="Description of Artificial Sequence: Synthetic heavy chain variable region CDR H2"
VISGSGGDTHSVVQGRGSGTYYADSVKG

SEQ ID NO: 934 - DNA, 84 bp, Artificial Sequence
  source: /note="Description of Artificial Sequence: Synthetic heavy chain variable region CDR H2"
gttattagtgggagtggtggtgacacacactccgtagttcaaggtcgtggtagtggcacatattacgcagactccgtgaagggc

SEQ ID NO: 935 - protein, 19 aa, Artificial Sequence
  source: /note="Description of Artificial Sequence: Synthetic heavy chain variable region CDR H3"
AKDDPTLFWSGSGYYGMDV

SEQ ID NO: 936 - DNA, 57 bp, Artificial Sequence
  source: /note="Description of Artificial Sequence: Synthetic heavy chain variable region CDR H3"
gcgaaagacgaccccacgcttttttggagtggttcggggtactacggaatggacgtc

SEQ ID NO: 937 - DNA, 321 bp, Artificial Sequence
  source: /note="Description of Artificial Sequence: Synthetic light chain variable region"
gacatccgggtgacccagtctccatcctccctgtctgcatctgttggagacagagtcaccatcacttgccaggcgagtcagggcattagcgactctttaaattggtatcagcagaaaccagggaaagcccctaagctcctgatctacggtgcatccaaattggaaccaggggtctcatcaaggttcagcggacgaggatctgggagagattttactttcaccatcagcagcctgcagcctgaagatatcggaacatattactgtcaacagtatgataatctccctctgactttcggccctgggaccaagctggagatcaaa

SEQ ID NO: 938 - protein, 107 aa, Artificial Sequence
  source: /note="Description of Artificial Sequence: Synthetic light chain variable region"
DIRVTQSPSSLSASVGDRVTITCQASQGISDSLNWYQQKPGKAPKLLIYGASKLEPGVSSRFSGRGSGRDFTFTISSLQPEDIGTYYCQQYDNLPLTFGPGTKLEIK

SEQ ID NO: 939 - protein, 11 aa, Artificial Sequence
  source: /note="Description of Artificial Sequence: Synthetic light chain variable region CDR L1"
QASQGISDSLN

SEQ ID NO: 940 - DNA, 33 bp, Artificial Sequence
  source: /note="Description of Artificial Sequence: Synthetic light chain variable region CDR L1"
caggcgagtcagggcattagcgactctttaaat

SEQ ID NO: 941 - protein, 7 aa, Artificial Sequence
  source: /note="Description of Artificial Sequence: Synthetic light chain variable region CDR L2"
GASKLEP

SEQ ID NO: 942 - DNA, 21 bp, Artificial Sequence
  source: /note="Description of Artificial Sequence: Synthetic light chain variable region CDR L2"
ggtgcatccaaattggaacca

SEQ ID NO: 943 - protein, 9 aa, Artificial Sequence
  source: /note="Description of Artificial Sequence: Synthetic light chain variable region CDR L3"
QQYDNLPLT

SEQ ID NO: 944 - DNA, 27 bp, Artificial Sequence
  source: /note="Description of Artificial Sequence: Synthetic light chain variable region CDR L3"
caacagtatgataatctccctctgact

SEQ ID NO: 945 - DNA, 375 bp, Artificial Sequence
  source: /note="Description of Artificial Sequence: Synthetic heavy chain variable region"
gaggtgcagctggtggagacggggggcggcttgatacagccgggggggtccctgagactctcctgcgtggcctccggattcagccttaggaactatgccttaggttggctccgccaggcgccagggaaggggctggagtgggtctcaggtggctattatggtgatgtctattacacggactccgtgaagggccggttcgccgtctccagggacaattccggggacacagtatatctagaaatggacaacctgagagtcgaagacacggccgtgtattactgtgcgagaatggagacagtgaccactgatgcaggctcgggatgggactggtacttcgaggtctggggccgcggcaccctggtcactgtctcctca

SEQ ID NO: 946 - protein, 125 aa, Artificial Sequence
  source: /note="Description of Artificial Sequence: Synthetic heavy chain variable region"
EVQLVETGGGLIQPGGSLRLSCVASGFSLRNYALGWLRQAPGKGLEWVSGGYYGDVYYTDSVKGRFAVSRDNSGDTVYLEMDNLRVEDTAVYYCARMETVTTDAGSGWDWYFEVWGRGTLVTVSS

SEQ ID NO: 947 - protein, 9 aa, Artificial Sequence
  source: /note="Description of Artificial Sequence: Synthetic heavy chain variable region CDR H1"
FSLRNYALG

SEQ ID NO: 948 - DNA, 27 bp, Artificial Sequence
  source: /note="Description of Artificial Sequence: Synthetic heavy chain variable region CDR H1"
ttcagccttaggaactatgccttaggt

SEQ ID NO: 949 - protein, 15 aa, Artificial Sequence
  source: /note="Description of Artificial Sequence: Synthetic heavy chain variable region CDR H2"
GGYYGDVYYTDSVKG

SEQ ID NO: 950 - DNA, 45 bp, Artificial Sequence
  source: /note="Description of Artificial Sequence: Synthetic heavy chain variable region CDR H2"
ggtggctattatggtgatgtctattacacggactccgtgaagggc

SEQ ID NO: 951 - protein, 20 aa, Artificial Sequence
  source: /note="Description of Artificial Sequence: Synthetic heavy chain variable region CDR H3"
ARMETVTTDAGSGWDWYFEV

SEQ ID NO: 952 - DNA, 60 bp, Artificial Sequence
  source: /note="Description of Artificial Sequence: Synthetic heavy chain variable region CDR H3"
gcgagaatggagacagtgaccactgatgcaggctcgggatgggactggtacttcgaggtc

SEQ ID NO: 953 - DNA, 324 bp, Artificial Sequence
  source: /note="Description of Artificial Sequence: Synthetic light chain variable region"
gaaacgacactcacgcagtctccagccaccctgtctttgtctccaggggattgggccaccctctcctgcagggccagtcagagtgttggcacctacttagcctggtaccaacacaaacctggccaggctcccagactcctcattcatgatgcatccaacagggccagtgacatcccatccaggttcagtggcagtgggtctgggacagacttcactctcaccatccgcggcctagagcctgaagattttgcagtttattactgtcagcaacatcgcgactggcggccggtcactttcggcggagggaccaaggtggaaatcaaa

SEQ ID NO: 954 - protein, 108 aa, Artificial Sequence
  source: /note="Description of Artificial Sequence: Synthetic light chain variable region"
ETTLTQSPATLSLSPGDWATLSCRASQSVGTYLAWYQHKPGQAPRLLIHDASNRASDIPSRFSGSGSGTDFTLTIRGLEPEDFAVYYCQQHRDWRPVTFGGGTKVEIK

SEQ ID NO: 955 - protein, 11 aa, Artificial Sequence
  source: /note="Description of Artificial Sequence: Synthetic light chain variable region CDR L1"
RASQSVGTYLA

SEQ ID NO: 956 - DNA, 33 bp, Artificial Sequence
  source: /note="Description of Artificial Sequence: Synthetic light chain variable region CDR L1"
agggccagtcagagtgttggcacctacttagcc

SEQ ID NO: 957 - protein, 7 aa, Artificial Sequence
  source: /note="Description of Artificial Sequence: Synthetic light chain variable region CDR L2"
DASNRAS

SEQ ID NO: 958 - DNA, 21 bp, Artificial Sequence
  source: /note="Description of Artificial Sequence: Synthetic light chain variable region CDR L2"
gatgcatccaacagggccagt

SEQ ID NO: 959 - protein, 10 aa, Artificial Sequence
  source: /note="Description of Artificial Sequence: Synthetic light chain variable region CDR L3"
QQHRDWRPVT

SEQ ID NO: 960 - DNA, 30 bp, Artificial Sequence
  source: /note="Description of Artificial Sequence: Synthetic light chain variable region CDR L3"
cagcaacatcgcgactggcggccggtcact

SEQ ID NO: 961 - DNA, 351 bp, Artificial Sequence
  source: /note="Description of Artificial Sequence: Synthetic heavy chain variable region"
caggtccagcttgtgcagtctggggctgaggcgaagaagcctggggcctcagtgaaggtctcctgcacggcgtctggatacaccttcaccaatgatattaactgggtgcgccaggccactggacaagggcttgagtggatggggtggatgaaccctaacaacggtcacacaggatatggacagaagttcgaggacagagtcaccttgacaagggactcctccagaagcacagcctacatggaactgagcagcctgagatttgaggacacggccgtgtactattgtgtatacaatttttggagcgattcttcagtcagttggggccggggaaccctggtcaccgtctcctca

SEQ ID NO: 962 - protein, 117 aa, Artificial Sequence
  source: /note="Description of Artificial Sequence: Synthetic heavy chain variable region"
QVQLVQSGAEAKKPGASVKVSCTASGYTFTNDINWVRQATGQGLEWMGWMNPNNGHTGYGQKFEDRVTLTRDSSRSTAYMELSSLRFEDTAVYYCVYNFWSDSSVSWGRGTLVTVSS

SEQ ID NO: 963 - protein, 8 aa, Artificial Sequence
  source: /note="Description of Artificial Sequence: Synthetic heavy chain variable region CDR H1"
YTFTNDIN

SEQ ID NO: 964 - DNA, 24 bp, Artificial Sequence
  source: /note="Description of Artificial Sequence: Synthetic heavy chain variable region CDR H1"
tacaccttcaccaatgatattaac

SEQ ID NO: 965 - protein, 17 aa, Artificial Sequence
  source: /note="Description of Artificial Sequence: Synthetic heavy chain variable region CDR H2"
WMNPNNGHTGYGQKFED

SEQ ID NO: 966 - DNA, 51 bp, Artificial Sequence
  source: /note="Description of Artificial Sequence: Synthetic heavy chain variable region CDR H2"
tggatgaaccctaacaacggtcacacaggatatggacagaagttcgaggac

SEQ ID NO: 967 - protein, 11 aa, Artificial Sequence
  source: /note="Description of Artificial Sequence: Synthetic heavy chain variable region CDR H3"
VYNFWSDSSVS

SEQ ID NO: 968 - DNA, 33 bp, Artificial Sequence
  source: /note="Description of Artificial Sequence: Synthetic heavy chain variable region CDR H3"
gtatacaatttttggagcgattcttcagtcagt

SEQ ID NO: 969 - DNA, 333 bp, Artificial Sequence
  source: /note="Description of Artificial Sequence: Synthetic light chain variable region"
cagtctgtcgtgacgcagccgccctcagtgtctggggccccagggcagagtgtcgccatctcctgcactgggagcagctccaacatcgggccagcctatgatgtacactggtaccagcagactccgggagcagcccccaaactcctcatctatggtgacagcaatcggccctcaggggtccctgaccgattctctacctccaagtctggcacctcagcctccctggccatcactgggctccaggctgaggatgaggctgattattactgccagtcctttgacagcagcctgcgtggttatgtcttcggaactgggaccaaggtgaccgtccta

SEQ ID NO: 970 - protein, 111 aa, Artificial Sequence
  source: /note="Description of Artificial Sequence: Synthetic light chain variable region"
QSVVTQPPSVSGAPGQSVAISCTGSSSNIGPAYDVHWYQQTPGAAPKLLIYGDSNRPSGVPDRFSTSKSGTSASLAITGLQAEDEADYYCQSFDSSLRGYVFGTGTKVTVL

SEQ ID NO: 971 - protein, 14 aa, Artificial Sequence
  source: /note="Description of Artificial Sequence: Synthetic light chain variable region CDR L1"
TGSSSNIGPAYDVH

SEQ ID NO: 972 - DNA, 42 bp, Artificial Sequence
  source: /note="Description of Artificial Sequence: Synthetic light chain variable region CDR L1"
actgggagcagctccaacatcgggccagcctatgatgtacac

SEQ ID NO: 973 - protein, 7 aa, Artificial Sequence
  source: /note="Description of Artificial Sequence: Synthetic light chain variable region CDR L2"
GDSNRPS

SEQ ID NO: 974 - DNA, 21 bp, Artificial Sequence
  source: /note="Description of Artificial Sequence: Synthetic light chain variable region CDR L2"
ggtgacagcaatcggccctca

SEQ ID NO: 975 - protein, 11 aa, Artificial Sequence
  source: /note="Description of Artificial Sequence: Synthetic light chain variable region CDR L3"
QSFDSSLRGYV

SEQ ID NO: 976 - DNA, 33 bp, Artificial Sequence; identical to SEQ ID NO: 352
  source: /note="Description of Artificial Sequence: Synthetic light chain variable region CDR L3"

SEQ ID NO: 977 - DNA, 369 bp, Artificial Sequence
  source: /note="Description of Artificial Sequence: Synthetic heavy chain variable region"
caggtccagctggtgcagtctggggctgaggtgaagaagcctggggcctcagtgaaggtctcctgcaaggcttctggatacaccttcaccagttatgatatcaactgggtgcgacaggccactggacatgggcttgagtggatgggatggatgagccctaacagtggttacacaggctatgcacagaagttccagggcagagtcaccatgagcaggaacacctccacaggcacagcctacatggagctgagcagcctgagatctgaggacacggccgtgtattactgtgcgagagaggcccgggacctacgagtgggagctactaactttgactactggggccagggaaccctggtcaccgtctcctca

SEQ ID NO: 978 - protein, 123 aa, Artificial Sequence
  source: /note="Description of Artificial Sequence: Synthetic heavy chain variable region"
QVQLVQSGAEVKKPGASVKVSCKASGYTFTSYDINWVRQATGHGLEWMGWMSPNSGYTGYAQKFQGRVTMSRNTSTGTAYMELSSLRSEDTAVYYCAREARDLRVGATNFDYWGQGTLVTVSS

SEQ ID NO: 979 - protein, 9 aa, Artificial Sequence
  source: /note="Description of Artificial Sequence: Synthetic heavy chain variable region CDR H1"
YTFTSYDIN

SEQ ID NO: 980 - DNA, 27 bp, Artificial Sequence
  source: /note="Description of Artificial Sequence: Synthetic heavy chain variable region CDR H1"
tacaccttcaccagttatgatatcaac

SEQ ID NO: 981 - protein, 17 aa, Artificial Sequence
  source: /note="Description of Artificial Sequence: Synthetic heavy chain variable region CDR H2"
WMSPNSGYTGYAQKFQG

SEQ ID NO: 982 - DNA, 51 bp, Artificial Sequence
  source: /note="Description of Artificial Sequence: Synthetic heavy chain variable region CDR H2"
tggatgagccctaacagtggttacacaggctatgcacagaagttccagggc

SEQ ID NO: 983 - protein, 16 aa, Artificial Sequence
  source: /note="Description of Artificial Sequence: Synthetic heavy chain variable region CDR H3"
AREARDLRVGATNFDY

SEQ ID NO: 984 - DNA, 48 bp, Artificial Sequence
  source: /note="Description of Artificial Sequence: Synthetic heavy chain variable region CDR H3"
gcgagagaggcccgggacctacgagtgggagctactaactttgactac

SEQ ID NO: 985 - DNA, 321 bp, Artificial Sequence
  source: /note="Description of Artificial Sequence: Synthetic light chain variable region"
cagcctgtgctgactcagccaccctcagtgtccgtgtccccaggacagacagccagcataacctgctctggagataaattgggagataaatatatttcgtggtatcaacagaggccaggccagtcccctgtaatggtaatttatcaagatagcaaggggccctcagggatccctgagcgattctctggctccaactctgggaacacagccactctgaccatcagcgggacgcaggctatggatgaggctgactattactgtcaggcgtgggacagcagcatagatgtggtattcggcggagggaccaagctcaccgtccta

SEQ ID NO: 986 - protein, 107 aa, Artificial Sequence
  source: /note="Description of Artificial Sequence: Synthetic light chain variable region"
QPVLTQPPSVSVSPGQTASITCSGDKLGDKYISWYQQRPGQSPVMVIYQDSKGPSGIPERFSGSNSGNTATLTISGTQAMDEADYYCQAWDSSIDVVFGGGTKLTVL

SEQ ID NO: 987 - protein, 11 aa, Artificial Sequence
  source: /note="Description of Artificial Sequence: Synthetic light chain variable region CDR L1"
SGDKLGDKYIS

SEQ ID NO: 988 - DNA, 33 bp, Artificial Sequence
  source: /note="Description of Artificial Sequence: Synthetic light chain variable region CDR L1"
tctggagataaattgggagataaatatatttcg

SEQ ID NO: 989 - protein, 7 aa, Artificial Sequence
  source: /note="Description of Artificial Sequence: Synthetic light chain variable region CDR L2"
QDSKGPS

SEQ ID NO: 990 - DNA, 21 bp, Artificial Sequence
  source: /note="Description of Artificial Sequence: Synthetic light chain variable region CDR L2"
caagatagcaaggggccctca

SEQ ID NO: 991 - protein, 10 aa, Artificial Sequence
  source: /note="Description of Artificial Sequence: Synthetic light chain variable region CDR L3"
QAWDSSIDVV

SEQ ID NO: 992 - DNA, 30 bp, Artificial Sequence
  source: /note="Description of Artificial Sequence: Synthetic light chain variable region CDR L3"
caggcgtgggacagcagcatagatgtggta

SEQ ID NO: 993 - DNA, 372 bp, Artificial Sequence
  source: /note="Description of Artificial Sequence: Synthetic heavy chain variable region"
caggtccagctggtgcagtctgggcctgagatgaagaagcctgggtcctccgtgaaggtctcctgcaagccttctggaggcaccttcagcagctactctgtcagctgggtgcgacaggcccctggacaagggcttgagtggatgggaggaatcatcccgatatttggttcgtcagactacgcacagaagtttcagggcagactcacaattacagaggacgaatccacgaagacatcctacatgcagctgaacaacctgacatctgacgacacggccatttatttctgtgcgagagacaactactatgtttggactggtcactatcccgaatttgacttctggggccagggaaccctggtcaccgtctcctca

SEQ ID NO: 994 - protein, 124 aa, Artificial Sequence
  source: /note="Description of Artificial Sequence: Synthetic heavy chain variable region"
QVQLVQSGPEMKKPGSSVKVSCKPSGGTFSSYSVSWVRQAPGQGLEWMGGIIPIFGSSDYAQKFQGRLTITEDESTKTSYMQLNNLTSDDTAIYFCARDNYYVWTGHYPEFDFWGQGTLVTVSS

SEQ ID NO: 995 - protein, 9 aa, Artificial Sequence
  source: /note="Description of Artificial Sequence: Synthetic heavy chain variable region CDR H1"
GTFSSYSVS

SEQ ID NO: 996 - DNA, 27 bp, Artificial Sequence
  source: /note="Description of Artificial Sequence: Synthetic heavy chain variable region CDR H1"
ggcaccttcagcagctactctgtcagc

SEQ ID NO: 997 - protein, 17 aa, Artificial Sequence
  source: /note="Description of Artificial Sequence: Synthetic heavy chain variable region CDR H2"
GIIPIFGSSDYAQKFQG

SEQ ID NO: 998 - DNA, 51 bp, Artificial Sequence
  source: /note="Description of Artificial Sequence: Synthetic heavy chain variable region CDR H2"
ggaatcatcccgatatttggttcgtcagactacgcacagaagtttcagggc

SEQ ID NO: 999 - protein, 17 aa, Artificial Sequence
  source: /note="Description of Artificial Sequence: Synthetic heavy chain variable region CDR H3"
ARDNYYVWTGHYPEFDF

SEQ ID NO: 1000 - DNA, 51 bp, Artificial Sequence
  source: /note="Description of Artificial Sequence: Synthetic heavy chain variable region CDR H3"
gcgagagacaactactatgtttggactggtcactatcccgaatttgacttc

SEQ ID NO: 1001 - DNA, 324 bp, Artificial Sequence
  source: /note="Description of Artificial Sequence: Synthetic light chain variable region"
gaaacgacactcacgcagtctccaggcaccctgtccttgtctctaggggagactgccaccctctcctgcagggccagtcagagtgtgagaagcgattacttagcctggtaccaacagaaaccaggccaggctcccaggctcctcatctctggtgcatccaacagggccactgccatcccagagaggttcactggcagtgggtctgggacagacttcactctcaccatcagcagcctggagcctgcagattttgcagtgtattattgtcagcagtatggtagcacaccgatcaccttcggccaggggacacgactggagattaaa

SEQ ID NO: 1002 - protein, 108 aa, Artificial Sequence
  source: /note="Description of Artificial Sequence: Synthetic light chain variable region"
ETTLTQSPGTLSLSLGETATLSCRASQSVRSDYLAWYQQKPGQAPRLLISGASNRATAIPERFTGSGSGTDFTLTISSLEPADFAVYYCQQYGSTPITFGQGTRLEIK

SEQ ID NO: 1003 - protein, 12 aa, Artificial Sequence
  source: /note="Description of Artificial Sequence: Synthetic light chain variable region CDR L1"
RASQSVRSDYLA

SEQ ID NO: 1004 - DNA, 36 bp, Artificial Sequence
  source: /note="Description of Artificial Sequence: Synthetic light chain variable region CDR L1"
agggccagtcagagtgtgagaagcgattacttagcc

SEQ ID NO: 1005 - protein, 7 aa, Artificial Sequence
  source: /note="Description of Artificial Sequence: Synthetic light chain variable region CDR L2"
GASNRAT

SEQ ID NO: 1006 - DNA, 21 bp, Artificial Sequence
  source: /note="Description of Artificial Sequence: Synthetic light chain variable region CDR L2"
ggtgcatccaacagggccact

SEQ ID NO: 1007 - protein, 9 aa, Artificial Sequence
  source: /note="Description of Artificial Sequence: Synthetic light chain variable region CDR L3"
QQYGSTPIT

SEQ ID NO: 1008 - DNA, 27 bp, Artificial Sequence
  source: /note="Description of Artificial Sequence: Synthetic light chain variable region CDR L3"
cagcagtatggtagcacaccgatcacc

SEQ ID NO: 1009 - DNA, 387 bp, Artificial Sequence
  source: /note="Description of Artificial Sequence: Synthetic heavy chain variable region"
caggtgcagctgcaggagtcggggggaggcttggtacagcctggggggtccctgagactctcctgttcagcctctggattcacctttagtaactatggcatgagttgggtccgccaggctccagggaaggggctggagtgggtctcaggtattggtgtgagtgatggaagcacacactacgcggactccgtgaagggccggttcatcatctccagagacaattccaagaacatgctgtctctgcaaatgagcagcctgggagtcgacgacacggccgtatattactgtgcgagaattgtaattgttggagtattacgatttcaggagtggttatcatctgacgggatggacgtctggggccaagggaccacggtcaccgtctcctca

SEQ ID NO: 1010 - protein, 129 aa, Artificial Sequence
  source: /note="Description of Artificial Sequence: Synthetic heavy chain variable region"
QVQLQESGGGLVQPGGSLRLSCSASGFTFSNYGMSWVRQAPGKGLEWVSGIGVSDGSTHYADSVKGRFIISRDNSKNMLSLQMSSLGVDDTAVYYCARIVIVGVLRFQEWLSSDGMDVWGQGTTVTVSS

SEQ ID NO: 1011 - protein, 9 aa, Artificial Sequence
  source: /note="Description of Artificial Sequence: Synthetic heavy chain variable region CDR H1"
FTFSNYGMS

SEQ ID NO: 1012 - DNA, 27 bp, Artificial Sequence
  source: /note="Description of Artificial Sequence: Synthetic heavy chain variable region CDR H1"
ttcacctttagtaactatggcatgagt

SEQ ID NO: 1013 - protein, 17 aa, Artificial Sequence
  source: /note="Description of Artificial Sequence: Synthetic heavy chain variable region CDR H2"
GIGVSDGSTHYADSVKG

SEQ ID NO: 1014 - DNA, 51 bp, Artificial Sequence
  source: /note="Description of Artificial Sequence: Synthetic heavy chain variable region CDR H2"
ggtattggtgtgagtgatggaagcacacactacgcggactccgtgaagggc

SEQ ID NO: 1015 - protein, 22 aa, Artificial Sequence
  source: /note="Description of Artificial Sequence: Synthetic heavy chain variable region CDR H3"
ARIVIVGVLRFQEWLSSDGMDV

SEQ ID NO: 1016 - DNA, 66 bp, Artificial Sequence
  source: /note="Description of Artificial Sequence: Synthetic heavy chain variable region CDR H3"
gcgagaattgtaattgttggagtattacgatttcaggagtggttatcatctgacgggatggacgtc

SEQ ID NO: 1017 - DNA, 321 bp, Artificial Sequence
  source: /note="Description of Artificial Sequence: Synthetic light chain variable region"
gatattgtgatgacccagactccatcttccgtgtctgcatctgtaggagacagagtcacgatcacttgtcgggcgagtcaggccattagtggcgggttagcctggtatcagcagaaagcaggaaaagcccctaaactcctgatctatgctgcatccaatttgccaagtggggtcccatcaaggttcagcggcagtggatctgggacagatttcactctcaccatcagcagcctgcagcctgaggattttgcgacttattattgtcaacaggctaacagtttccccttcaccttcggccaagggacacgactggagattaaa

SEQ ID NO: 1018 - protein, 107 aa, Artificial Sequence
  source: /note="Description of Artificial Sequence: Synthetic light chain variable region"
DIVMTQTPSSVSASVGDRVTITCRASQAISGGLAWYQQKAGKAPKLLIYAASNLPSGVPSRFSGSGSGTDFTLTISSLQPEDFATYYCQQANSFPFTFGQGTRLEIK

SEQ ID NO: 1019 - protein, 11 aa, Artificial Sequence
  source: /note="Description of Artificial Sequence: Synthetic light chain variable region CDR L1"
RASQAISGGLA

SEQ ID NO: 1020 - DNA, 33 bp, Artificial Sequence
  source: /note="Description of Artificial Sequence: Synthetic light chain variable region CDR L1"
cgggcgagtcaggccattagtggcgggttagcc

SEQ ID NO: 1021 - protein, 7 aa, Artificial Sequence
  source: /note="Description of Artificial Sequence: Synthetic light chain variable region CDR L2"
AASNLPS

SEQ ID NO: 1022 - DNA, 21 bp, Artificial Sequence
  source: /note="Description of Artificial Sequence: Synthetic light chain variable region CDR L2"
gctgcatccaatttgccaagt

SEQ ID NO: 1023 - protein, 9 aa, Artificial Sequence
  source: /note="Description of Artificial Sequence: Synthetic light chain variable region CDR L3"
QQANSFPFT

SEQ ID NO: 1024 - DNA, 27 bp, Artificial Sequence
  source: /note="Description of Artificial Sequence: Synthetic light chain variable region CDR L3"
caacaggctaacagtttccccttcacc

SEQ ID NO: 1025 - DNA, 357 bp, Artificial Sequence
  source: /note="Description of Artificial Sequence: Synthetic heavy chain variable region"
gaggtgcagctgttggagtctgggggaggcctggtcaagcctggggggtccctgagactctcctgtgcagcctcgggattcaccatcggtggttataacatgttctgggtccgccagcctccggggaaggggctggagtgggtctcatccattactgctggtagtagttatttaaactatgcagactcagtgaagggccgtttcatcgtctccagagacaacgccaagaattcactgtatctgcaaatgaacagcctgagagccgaggacacggctgtttatttctgtgcgagagcacctcttttacccgctatgatggacctctggggccaagggaccacggtcaccgtctcctca

SEQ ID NO: 1026 - protein, 119 aa, Artificial Sequence
  source: /note="Description of Artificial Sequence: Synthetic heavy chain variable region"
EVQLLESGGGLVKPGGSLRLSCAASGFTIGGYNMFWVRQPPGKGLEWVSSITAGSSYLNYADSVKGRFIVSRDNAKNSLYLQMNSLRAEDTAVYFCARAPLLPAMMDLWGQGTTVTVSS

SEQ ID NO: 1027 - protein, 9 aa, Artificial Sequence
  source: /note="Description of Artificial Sequence: Synthetic heavy chain variable region CDR H1"
FTIGGYNMF

SEQ ID NO: 1028 - DNA, 27 bp, Artificial Sequence
  source: /note="Description of Artificial Sequence: Synthetic heavy chain variable region CDR H1"
ttcaccatcggtggttataacatgttc

SEQ ID NO: 1029 - protein, 17 aa, Artificial Sequence
  source: /note="Description of Artificial Sequence: Synthetic heavy chain variable region CDR H2"
SITAGSSYLNYADSVKG

SEQ ID NO: 1030 - DNA, 51 bp, Artificial Sequence; identical to SEQ ID NO: 326
  source: /note="Description of Artificial Sequence: Synthetic heavy chain variable region CDR H2"

SEQ ID NO: 1031 - protein, 12 aa, Artificial Sequence
  source: /note="Description of Artificial Sequence: Synthetic heavy chain variable region CDR H3"
ARAPLLPAMMDL

SEQ ID NO: 1032 - DNA, 36 bp, Artificial Sequence; identical to SEQ ID NO: 328
  source: /note="Description of Artificial Sequence: Synthetic heavy chain variable region CDR H3"

SEQ ID NO: 1033 - DNA, 333 bp, Artificial Sequence
  source: /note="Description of Artificial Sequence: Synthetic light chain variable region"
cagtctgtggtgacgcagccgccctcagtgtctggggccccagggcagagggtcaccatctcctgcactgggagcagctccaacatcggggcaggttatgatgtacactggtaccagcaacttccaggaacagcccccaaactcctcatctatactaacaacaatcggccctcaggggtccctgaccgattctctggctccaagtctggcacctcagcctccctggccatcactgggctccaggctgaggatgaggctgactattactgccagtcctatgacagaagcctgaatggttatgtcttcggaactggcacccagctgaccgtcctc

SEQ ID NO: 1034 - protein, 111 aa, Artificial Sequence
  source: /note="Description of Artificial Sequence: Synthetic light chain variable region"
QSVVTQPPSVSGAPGQRVTISCTGSSSNIGAGYDVHWYQQLPGTAPKLLIYTNNNRPSGVPDRFSGSKSGTSASLAITGLQAEDEADYYCQSYDRSLNGYVFGTGTQLTVL

SEQ ID NO: 1035 - protein, 14 aa, Artificial Sequence
  source: /note="Description of Artificial Sequence: Synthetic light chain variable region CDR L1"
TGSSSNIGAGYDVH

SEQ ID NO: 1036 - DNA, 42 bp, Artificial Sequence; identical to SEQ ID NO: 60
  source: /note="Description of Artificial Sequence: Synthetic light chain variable region CDR L1"

SEQ ID NO: 1037 - protein, 7 aa, Artificial Sequence
  source: /note="Description of Artificial Sequence: Synthetic light chain variable region CDR L2"
TNNNRPS

SEQ ID NO: 1038 - DNA, 21 bp, Artificial Sequence
  source: /note="Description of Artificial Sequence: Synthetic light chain variable region CDR L2"
actaacaacaatcggccctca

SEQ ID NO: 1039 - protein, 11 aa, Artificial Sequence
  source: /note="Description of Artificial Sequence: Synthetic light chain variable region CDR L3"
QSYDRSLNGYV

SEQ ID NO: 1040 - DNA, 33 bp, Artificial Sequence; identical to SEQ ID NO: 336
  source: /note="Description of Artificial Sequence: Synthetic light chain variable region CDR L3"

SEQ ID NO: 1041 - DNA, 363 bp, Artificial Sequence
  source: /note="Description of Artificial Sequence: Synthetic heavy chain variable region"
caggtccagcttgtacagtctgggggaggcttggtcaaggctggagggtccctgagactctcctgtgcagcctctggattcaccatcagtggcttctacatgacctggatccgccaggctccagggaaggggctggagtgggtttcatccattagtggtagtagtagttacacaaactacgcagactctgtgaagggccgattcaccatctccagagacaacgccaagaactcactgtatctgcacatgaacagcctgagagccgaggacacggctgtatattactgtgcgagaataaggccggatgatagtagtggttatcctgactactggggccagggaaccctggtcaccgtctcctca

SEQ ID NO: 1042 - protein, 121 aa, Artificial Sequence
  source: /note="Description of Artificial Sequence: Synthetic heavy chain variable region"
QVQLVQSGGGLVKAGGSLRLSCAASGFTISGFYMTWIRQAPGKGLEWVSSISGSSSYTNYADSVKGRFTISRDNAKNSLYLHMNSLRAEDTAVYYCARIRPDDSSGYPDYWGQGTLVTVSS

SEQ ID NO: 1043 - protein, 9 aa, Artificial Sequence
  source: /note="Description of Artificial Sequence: Synthetic heavy chain variable region CDR H1"
FTISGFYMT

SEQ ID NO: 1044 - DNA, 27 bp, Artificial Sequence
  source: /note="Description of Artificial Sequence: Synthetic heavy chain variable region CDR H1"
ttcaccatcagtggcttctacatgacc

SEQ ID NO: 1045 - protein, 17 aa, Artificial Sequence
  source: /note="Description of Artificial Sequence: Synthetic heavy chain variable region CDR H2"
SISGSSSYTNYADSVKG

SEQ ID NO: 1046 - DNA, 51 bp, Artificial Sequence
  source: /note="Description of Artificial Sequence: Synthetic heavy chain variable region CDR H2"
tccattagtggtagtagtagttacacaaactacgcagactctgtgaagggc

SEQ ID NO: 1047 - protein, 14 aa, Artificial Sequence
  source: /note="Description of Artificial Sequence: Synthetic heavy chain variable region CDR H3"
ARIRPDDSSGYPDY

SEQ ID NO: 1048 - DNA, 42 bp, Artificial Sequence
  source: /note="Description of Artificial Sequence: Synthetic heavy chain variable region CDR H3"
gcgagaataaggccggatgatagtagtggttatcctgactac

SEQ ID NO: 1049 - DNA, 333 bp, Artificial Sequence
  source: /note="Description of Artificial Sequence: Synthetic light chain variable region"
cagtctgtgttgacgcagccgccctcagtgtctggggccccagggcagagggtcaccatctcctgcactgggagcagctccaacatcggggctggttatgatgtacactggtgccagcagcttccaggaacagcccccaaactcctcatctatggtaacaacaatcggccctcaggggtccctgaccgattctctggctccaagtctggcacctcagcctccctggccatcactgggctccaggctgaggatgaggctgattattactgccagtcctatgacagcagcctgagtggctttgtcttcggaactgggaccaaggtgaccgtccta

SEQ ID NO: 1050 - protein, 111 aa, Artificial Sequence
  source: /note="Description of Artificial Sequence: Synthetic light chain variable region"
QSVLTQPPSVSGAPGQRVTISCTGSSSNIGAGYDVHWCQQLPGTAPKLLIYGNNNRPSGVPDRFSGSKSGTSASLAITGLQAEDEADYYCQSYDSSLSGFVFGTGTKVTVL

SEQ ID NO: 1051 - protein, 14 aa, Artificial Sequence
  source: /note="Description of Artificial Sequence: Synthetic light chain variable region CDR L1"
TGSSSNIGAGYDVH

SEQ ID NO: 1052 - DNA, 42 bp, Artificial Sequence
  source: /note="Description of Artificial Sequence: Synthetic light chain variable region CDR L1"
actgggagcagctccaacatcggggctggttatgatgtacac

SEQ ID NO: 1053 - protein, 7 aa, Artificial Sequence
  source: /note="Description of Artificial Sequence: Synthetic light chain variable region CDR L2"
GNNNRPS

SEQ ID NO: 1054 - DNA, 21 bp, Artificial Sequence
  source: /note="Description of Artificial Sequence: Synthetic light chain variable region CDR L2"
ggtaacaacaatcggccctca

SEQ ID NO: 1055 - protein, 11 aa, Artificial Sequence
  source: /note="Description of Artificial Sequence: Synthetic light chain variable region CDR L3"
QSYDSSLSGFV

SEQ ID NO: 1056 - DNA, 33 bp, Artificial Sequence
  source: /note="Description of Artificial Sequence: Synthetic light chain variable region CDR L3"
cagtcctatgacagcagcctgagtggctttgtc

SEQ ID NO: 1057 - DNA, 378 bp, Artificial Sequence
  source: /note="Description of Artificial Sequence: Synthetic heavy chain variable region"
gaggtgcagctggtggagtctggggctgaggtgaggaagcctggggcctcagtgcaggtttcctgcaaggcatctggatacaccttcaccagctactatatgcactgggtgcgacaggcccctggacacgggcttgagtggatgggaatgatctaccctagtggtggtagcacaagctacgcacagaagttccagggcagagtcaccatgaccagggacacgtccacgagcacagtctacatggagctgagcagcctgagatctgaggacgcggccgtgtattactgtgcgagagaccgggcagggtgtagtggtggtagctgttactattatggtatggacgtctggggccaagggaccacggtcaccgtctcctca

SEQ ID NO: 1058 - protein, 126 aa, Artificial Sequence
  source: /note="Description of Artificial Sequence: Synthetic heavy chain variable region"
EVQLVESGAEVRKPGASVQVSCKASGYTFTSYYMHWVRQAPGHGLEWMGMIYPSGGSTSYAQKFQGRVTMTRDTSTSTVYMELSSLRSEDAAVYYCARDRAGCSGGSCYYYGMDVWGQGTTVTVSS

SEQ ID NO: 1059 - protein, 9 aa, Artificial Sequence
  source: /note="Description of Artificial Sequence: Synthetic heavy chain variable region CDR H1"
YTFTSYYMH

SEQ ID NO: 1060 - DNA, 27 bp, Artificial Sequence
  source: /note="Description of Artificial Sequence: Synthetic heavy chain variable region CDR H1"
tacaccttcaccagctactatatgcac

SEQ ID NO: 1061 - protein, 17 aa, Artificial Sequence
  source: /note="Description of Artificial Sequence: Synthetic heavy chain variable region CDR H2"
MIYPSGGSTSYAQKFQG

SEQ ID NO: 1062 - DNA, 51 bp, Artificial Sequence
  source: /note="Description of Artificial Sequence: Synthetic heavy chain variable region CDR H2"
atgatctaccctagtggtggtagcacaagctacgcacagaagttccagggc

SEQ ID NO: 1063 - protein, 19 aa, Artificial Sequence
  source: /note="Description of Artificial Sequence: Synthetic heavy chain variable region CDR H3"
ARDRAGCSGGSCYYYGMDV

SEQ ID NO: 1064 - DNA, 57 bp, Artificial Sequence
  source: /note="Description of Artificial Sequence: Synthetic heavy chain variable region CDR H3"
gcgagagaccgggcagggtgtagtggtggtagctgttactattatggtatggacgtc

SEQ ID NO: 1065 - DNA, 318 bp, Artificial Sequence
  source: /note="Description of Artificial Sequence: Synthetic light chain variable region"
aattttatgctgactcagcccccctcagtgtccgtgtccccaggacagacagccagcatcacctgctctggaaataaattgggggataaatatgcttgctggtatcaacaaaagccaggccagtcccctgtgctggtcatctctcaagatagcaagcggccctcagggatccctgagcgattctctggctccaactctgggaacacagccactctgaccatcagcgggacccaggctatggatgaggctgactattactgtcaggcgtgggacagtagaactgttgtattcggcggagggaccaagctgaccgtccta

SEQ ID NO: 1066 - protein, 106 aa, Artificial Sequence
  source: /note="Description of Artificial Sequence: Synthetic light chain variable region"
NFMLTQPPSVSVSPGQTASITCSGNKLGDKYACWYQQKPGQSPVLVISQDSKRPSGIPERFSGSNSGNTATLTISGTQAMDEADYYCQAWDSRTVVFGGGTKLTVL

SEQ ID NO: 1067 - protein, 11 aa, Artificial Sequence
  source: /note="Description of Artificial Sequence: Synthetic light chain variable region CDR L1"
SGNKLGDKYAC

SEQ ID NO: 1068 - DNA, 33 bp, Artificial Sequence
  source: /note="Description of Artificial Sequence: Synthetic light chain variable region CDR L1"
tctggaaataaattgggggataaatatgcttgc

SEQ ID NO: 1069 - protein, 7 aa, Artificial Sequence
  source: /note="Description of Artificial Sequence: Synthetic light chain variable region CDR L2"
QDSKRPS

SEQ ID NO: 1070 - DNA, 21 bp, Artificial Sequence
  source: /note="Description of Artificial Sequence: Synthetic light chain variable region CDR L2"
caagatagcaagcggccctca

SEQ ID NO: 1071 - protein, 9 aa, Artificial Sequence
  source: /note="Description of Artificial Sequence: Synthetic light chain variable region CDR L3"
QAWDSRTVV

SEQ ID NO: 1072 - DNA, 27 bp, Artificial Sequence
  source: /note="Description of Artificial Sequence: Synthetic light chain variable region CDR L3"
caggcgtgggacagtagaactgttgta

SEQ ID NO: 1073 - DNA, 381 bp, Artificial Sequence
  source: /note="Description of Artificial Sequence: Synthetic heavy chain variable region"
gaggtgcagctggtggagtctggggctgaggtgaagaagcctgggtcctcggtgaaggtctcctgcaaggcttctggaggcaccttcagtagttatgaaatcagctgggtgcgacaggcccctggacaaggacttgagtggatgggagggatcaaccctatgtttggagcagcaaactacgcacagaagttccaggacagagtcacgattatcgcggacaaatccacgggcacagtctacatggaactgagcagcctgagatctgaggacacggccctctattactgtgcgagagaacgctacccgtctacggatgactattataggagtggtcgttactacggggagtggggccaggggaccacggtcaccgtctcctca

SEQ ID NO: 1074 - protein, 127 aa, Artificial Sequence
  source: /note="Description of Artificial Sequence: Synthetic heavy chain variable region"
EVQLVESGAEVKKPGSSVKVSCKASGGTFSSYEISWVRQAPGQGLEWMGGINPMFGAANYAQKFQDRVTIIADKSTGTVYMELSSLRSEDTALYYCARERYPSTDDYYRSGRYYGEWGQGTTVTVSS

SEQ ID NO: 1075 - protein, 9 aa, Artificial Sequence
  source: /note="Description of Artificial Sequence: Synthetic heavy chain variable region CDR H1"
GTFSSYEIS

SEQ ID NO: 1076 - DNA, 27 bp, Artificial Sequence
  source: /note="Description of Artificial Sequence: Synthetic heavy chain variable region CDR H1"
ggcaccttcagtagttatgaaatcagc

SEQ ID NO: 1077 - protein, 17 aa, Artificial Sequence
  source: /note="Description of Artificial Sequence: Synthetic heavy chain variable region CDR H2"
GINPMFGAANYAQKFQD

SEQ ID NO: 1078 - DNA, 51 bp, Artificial Sequence
  source: /note="Description of Artificial Sequence: Synthetic heavy chain variable region CDR H2"
gggatcaaccctatgtttggagcagcaaactacgcacagaagttccaggac

SEQ ID NO: 1079 - protein, 20 aa, Artificial Sequence
  source: /note="Description of Artificial Sequence: Synthetic heavy chain variable region CDR H3"
ARERYPSTDDYYRSGRYYGE

SEQ ID NO: 1080 - DNA, 60 bp, Artificial Sequence
  source: /note="Description of Artificial Sequence: Synthetic heavy chain variable region CDR H3"
gcgagagaacgctacccgtctacggatgactattataggagtggtcgttactacggggag

SEQ ID NO: 1081 - DNA, 321 bp, Artificial Sequence
  source: /note="Description of Artificial Sequence: Synthetic light chain variable region"
gaaacgacactcacgcagtctccttccaccctgtctgcatctgtaggagacagagtcaccatcacttgccgggccagtcagagtattcgtagttggttggcctggtatcagcagaaaccagggaaagccccgaagctcctgatctatagggcgtctacttcagacagtggggtcccatcaaggttcagcggcagtggatctgggacagaattcacgctcaccatcagcagcctgcagcctgatgattttgcaatttattactgccaacagtataatagcatcccagtgacgttcggccaagggaccaagctggagatcaaa

SEQ ID NO: 1082 - protein, 107 aa, Artificial Sequence
  source: /note="Description of Artificial Sequence: Synthetic light chain variable region"
ETTLTQSPSTLSASVGDRVTITCRASQSIRSWLAWYQQKPGKAPKLLIYRASTSDSGVPSRFSGSGSGTEFTLTISSLQPDDFAIYYCQQYNSIPVTFGQGTKLEIK

SEQ ID NO: 1083 - protein, 11 aa, Artificial Sequence
  source: /note="Description of Artificial Sequence: Synthetic light chain variable region CDR L1"
RASQSIRSWLA

SEQ ID NO: 1084 - DNA, 33 bp, Artificial Sequence
  source: /note="Description of Artificial Sequence: Synthetic light chain variable region CDR L1"
cgggccagtcagagtattcgtagttggttggcc

SEQ ID NO: 1085 - protein, 7 aa, Artificial Sequence
  source: /note="Description of Artificial Sequence: Synthetic light chain variable region CDR L2"
RASTSDS

SEQ ID NO: 1086 - DNA, 21 bp, Artificial Sequence
  source: /note="Description of Artificial Sequence: Synthetic light chain variable region CDR L2"
agggcgtctacttcagacagt

SEQ ID NO: 1087 - protein, 9 aa, Artificial Sequence
  source: /note="Description of Artificial Sequence: Synthetic light chain variable region CDR L3"
QQYNSIPVT

SEQ ID NO: 1088 - DNA, 27 bp, Artificial Sequence
  source: /note="Description of Artificial Sequence: Synthetic light chain variable region CDR L3"
caacagtataatagcatcccagtgacg

SEQ ID NO: 1089 - DNA, 369 bp, Artificial Sequence
  source: /note="Description of Artificial Sequence: Synthetic heavy chain variable region"
gaggtgcagctggtggagtctgggggaggcgtggtccagcctgggaggtccctgagactctcctgtgcagcgtctggattcacattcagtgactatgccatgcactgggtccgccaggctccaggcaaggggctggagtgggtggcagttatatggtatgatggaggtaataaatactatgcagactccgcgaagggccgattcaccatctccagagacaattccaagaacacgctgtatctgcaaatgaacagcctgagagccgaggacacggctgtgtattactgtgcgaaagatcgcgggtctatctggaacgttggggatggtatggacgtctggggccaagggaccacggtcaccgtctcttca

SEQ ID NO: 1090 - protein, 123 aa, Artificial Sequence
  source: /note="Description of Artificial Sequence: Synthetic heavy chain variable region"
EVQLVESGGGVVQPGRSLRLSCAASGFTFSDYAMHWVRQAPGKGLEWVAVIWYDGGNKYYADSAKGRFTISRDNSKNTLYLQMNSLRAEDTAVYYCAKDRGSIWNVGDGMDVWGQGTTVTVSS

SEQ ID NO: 1091 - protein, 9 aa, Artificial Sequence
  source: /note="Description of Artificial Sequence: Synthetic heavy chain variable region CDR H1"
FTFSDYAMH

SEQ ID NO: 1092 - DNA, 27 bp, Artificial Sequence
  source: /note="Description of Artificial Sequence: Synthetic heavy chain variable region CDR H1"
ttcacattcagtgactatgccatgcac

SEQ ID NO: 1093 - protein, 17 aa, Artificial Sequence
  source: /note="Description of Artificial Sequence: Synthetic heavy chain variable region CDR H2"
VIWYDGGNKYYADSAKG

SEQ ID NO: 1094 - DNA, 51 bp, Artificial Sequence
  source: /note="Description of Artificial Sequence: Synthetic heavy chain variable region CDR H2"
gttatatggtatgatggaggtaataaatactatgcagactccgcgaagggc

SEQ ID NO: 1095 - protein, 16 aa, Artificial Sequence
  source: /note="Description of Artificial Sequence: Synthetic heavy chain variable region CDR H3"
AKDRGSIWNVGDGMDV

SEQ ID NO: 1096 - DNA, 48 bp, Artificial Sequence
  source: /note="Description of Artificial Sequence: Synthetic heavy chain variable region CDR H3"
gcgaaagatcgcgggtctatctggaacgttggggatggtatggacgtc

SEQ ID NO: 1097 - DNA, 327 bp, Artificial Sequence
  source: /note="Description of Artificial Sequence: Synthetic light chain variable region"
cagcctgtgctgactcagccaccctcggtgtcagtggccccaggacagacggccagggttacctgtgggggaaacaacattggagctaagagtgtccactggtaccagcagaagccaggccaggcccctgtgctggtcgtcgatgatgataccgaccggccctcagggatccctgagcgattctctggctccaactctgggaacacggccaccctgaccatcagcagggtcgaagccggggatgaggccgactattactgtcaggtgtgggatgctagtattggtcctctttatgtcttcggaactgggaccaagctcaccgtccta

SEQ ID NO: 1098 - protein, 109 aa, Artificial Sequence
  source: /note="Description of Artificial Sequence: Synthetic light chain variable region"
QPVLTQPPSVSVAPGQTARVTCGGNNIGAKSVHWYQQKPGQAPVLVVDDDTDRPSGIPERFSGSNSGNTATLTISRVEAGDEADYYCQVWDASIGPLYVFGTGTKLTVL

SEQ ID NO: 1099 - protein, 11 aa, Artificial Sequence
  source: /note="Description of Artificial Sequence: Synthetic light chain variable region CDR L1"
GGNNIGAKSVH

SEQ ID NO: 1100 - DNA, 33 bp, Artificial Sequence
  source: /note="Description of Artificial Sequence: Synthetic light chain variable region CDR L1"
gggggaaacaacattggagctaagagtgtccac

SEQ ID NO: 1101 - protein, 7 aa, Artificial Sequence
  source: /note="Description of Artificial Sequence: Synthetic light chain variable region CDR L2"
DDTDRPS

SEQ ID NO: 1102 - DNA, 21 bp, Artificial Sequence
  source: /note="Description of Artificial Sequence: Synthetic light chain variable region CDR L2"
gatgataccgaccggccctca

SEQ ID NO: 1103 - protein, 12 aa, Artificial Sequence
  source: /note="Description of Artificial Sequence: Synthetic light chain variable region CDR L3"
QVWDASIGPLYV

SEQ ID NO: 1104 - DNA, 36 bp, Artificial Sequence
  source: /note="Description of Artificial Sequence: Synthetic light chain variable region CDR L3"
caggtgtgggatgctagtattggtcctctttatgtc

SEQ ID NO: 1105 - DNA, 372 bp, Artificial Sequence
  source: /note="Description of Artificial Sequence: Synthetic heavy chain variable region"
caggtccagctggtgcagtctgggggaggcgtggtccagcctgggaggtccctgagactctcctgtgcagcctctggtttcaccttcagtgacttttctatgcactgggtccgccaggctccaggcaaggggctggagtgggtggcactcatctcaaatgatggaagcaataaatattattcagactccctgaagggttcattcatcatctccagagacaactccaagaacacgctctatctccaactgaacagcctgggagctgaggacacggctctgtattactgtgcgagagatgcggttccccattatgattacgtctggggaaactttgactactggggcccgggaaccctggtcaccgtctcctca

SEQ ID NO: 1106 - protein, 124 aa, Artificial Sequence
  source: /note="Description of Artificial Sequence: Synthetic heavy chain variable region"
QVQLVQSGGGVVQPGRSLRLSCAASGFTFSDFSMHWVRQAPGKGLEWVALISNDGSNKYYSDSLKGSFIISRDNSKNTLYLQLNSLGAEDTALYYCARDAVPHYDYVWGNFDYWGPGTLVTVSS

SEQ ID NO: 1107 - protein, 9 aa, Artificial Sequence
  source: /note="Description of Artificial Sequence: Synthetic heavy chain variable region CDR H1"
FTFSDFSMH

SEQ ID NO: 1108 - DNA, 27 bp, Artificial Sequence
  source: /note="Description of Artificial Sequence: Synthetic heavy chain variable region CDR H1"
ttcaccttcagtgacttttctatgcac

SEQ ID NO: 1109 - protein, 17 aa, Artificial Sequence
  source: /note="Description of Artificial Sequence: Synthetic heavy chain variable region CDR H2"
LISNDGSNKYYSDSLKG

SEQ ID NO: 1110 - DNA, 51 bp, Artificial Sequence
  source: /note="Description of Artificial Sequence: Synthetic heavy chain variable region CDR H2"
ctcatctcaaatgatggaagcaataaatattattcagactccctgaagggt

SEQ ID NO: 1111 - protein, 17 aa, Artificial Sequence
  source: /note="Description of Artificial Sequence: Synthetic heavy chain variable region CDR H3"
ARDAVPHYDYVWGNFDY

SEQ ID NO: 1112 - DNA, 51 bp, Artificial Sequence
  source: /note="Description of Artificial Sequence: Synthetic heavy chain variable region CDR H3"
gcgagagatgcggttccccattatgattacgtctggggaaactttgactac

SEQ ID NO: 1113 - DNA, 330 bp, Artificial Sequence
  source: /note="Description of Artificial Sequence: Synthetic light chain variable region"
cagcctgtgctgactcagcctgcctccgtgtctgcgtctcctggacagtcgatcaccatctcctgcactggaaccagcagtgacgttggtggttataattatgtctcctggtaccaacagcacccaggcaaagcccccaaactcatagtttatgaggtcagtaatcggccctcaggggtttctaatcgcttctctggctccaagtctggcaacacggcctccctgaccatctctgggctccaggctgacgacgaggctgattattactgcagctcatatacaagtttcactcccgtggtattcggcggagggaccaaggtgaccgtccta

SEQ ID NO: 1114 - protein, 110 aa, Artificial Sequence
  source: /note="Description of Artificial Sequence: Synthetic light chain variable region"
QPVLTQPASVSASPGQSITISCTGTSSDVGGYNYVSWYQQHPGKAPKLIVYEVSNRPSGVSNRFSGSKSGNTASLTISGLQADDEADYYCSSYTSFTPVVFGGGTKVTVL

SEQ ID NO: 1115 - protein, 14 aa, Artificial Sequence
  source: /note="Description of Artificial Sequence: Synthetic light chain variable region CDR L1"
TGTSSDVGGYNYVS

SEQ ID NO: 1116 - DNA, 42 bp, Artificial Sequence
  source: /note="Description of Artificial Sequence: Synthetic light chain variable region CDR L1"
actggaaccagcagtgacgttggtggttataattatgtctcc

SEQ ID NO: 1117 - protein, 7 aa, Artificial Sequence
  source: /note="Description of Artificial Sequence: Synthetic light chain variable region CDR L2"
EVSNRPS

SEQ ID NO: 1118 - DNA, 21 bp, Artificial Sequence
  source: /note="Description of Artificial Sequence: Synthetic light chain variable region CDR L2"
gaggtcagtaatcggccctca

SEQ ID NO: 1119 - protein, 10 aa, Artificial Sequence
  source: /note="Description of Artificial Sequence: Synthetic light chain variable region CDR L3"
SSYTSFTPVV

SEQ ID NO: 1120 - DNA, 30 bp, Artificial Sequence
  source: /note="Description of Artificial Sequence: Synthetic light chain variable region CDR L3"
agctcatatacaagtttcactcccgtggta

SEQ ID NO: 1121 - DNA, 378 bp, Artificial Sequence
  source: /note="Description of Artificial Sequence: Synthetic heavy chain variable region"
gaggtgcagctggtggagtctgggggaggcttggttcagcctggggggtccctgagactctcctgtgcagcctctggattcacttttagcgactttgccatgagctgggtccgccaggctccagggaaggggctggagtgggtctcacttattaaaagtagtgattatgcatactatgcagactccgtgaggggccggttcaccatctccagagacaattccaagaacaccctgtatctgcgaatgaacagcctgagagccgacgacacggccgtatattactgtgcgaaagacgccgatttttggagtggtgattcctacaatggagggtacaactttgactcctggggccagggaaccctggtcaccgtctcctca

SEQ ID NO: 1122 - protein, 126 aa, Artificial Sequence
  source: /note="Description of Artificial Sequence: Synthetic heavy chain variable region"
EVQLVESGGGLVQPGGSLRLSCAASGFTFSDFAMSWVRQAPGKGLEWVSLIKSSDYAYYADSVRGRFTISRDNSKNTLYLRMNSLRADDTAVYYCAKDADFWSGDSYNGGYNFDSWGQGTLVTVSS

SEQ ID NO: 1123 - protein, 9 aa, Artificial Sequence
  source: /note="Description of Artificial Sequence: Synthetic heavy chain variable region CDR H1"
FTFSDFAMS

SEQ ID NO: 1124 - DNA, 27 bp, Artificial Sequence
  source: /note="Description of Artificial Sequence: Synthetic heavy chain variable region CDR H1"
ttcacttttagcgactttgccatgagc

SEQ ID NO: 1125 - protein, 16 aa, Artificial Sequence
  source: /note="Description of Artificial Sequence: Synthetic heavy chain variable region CDR H2"
LIKSSDYAYYADSVRG

SEQ ID NO: 1126 - DNA, 48 bp, Artificial Sequence
  source: /note="Description of Artificial Sequence: Synthetic heavy chain variable region CDR H2"
cttattaaaagtagtgattatgcatactatgcagactccgtgaggggc

SEQ ID NO: 1127 - protein, 20 aa, Artificial Sequence
  source: /note="Description of Artificial Sequence: Synthetic heavy chain variable region CDR H3"
AKDADFWSGDSYNGGYNFDS

SEQ ID NO: 1128 - DNA, 60 bp, Artificial Sequence
  source: /note="Description of Artificial Sequence: Synthetic heavy chain variable region CDR H3"
gcgaaagacgccgatttttggagtggtgattcctacaatggagggtacaactttgactcc

SEQ ID NO: 1129 - DNA, 324 bp, Artificial Sequence
  source: /note="Description of Artificial Sequence: Synthetic light chain variable region"
gatattgtgctgacccagtctccagccaccctgtctgtatctccaggggaaagagccaccctctcctgcagggccagtcagagtgttggcaccaacttggcctggtaccagcaaaaacctggccaggctccccggctcctcatctttggtgcctcaaccagggccactggtatcccagccaggttcagtggcagtgggtctgggacagagttcactctcaccatcagcagcctgcagtctgaagattttgcagtttattactgtcagcagtataataagtggcctccgctcactttcggcggagggaccaaagtggatatcaaa

SEQ ID NO: 1130 - protein, 108 aa, Artificial Sequence
  source: /note="Description of Artificial Sequence: Synthetic light chain variable region"
DIVLTQSPATLSVSPGERATLSCRASQSVGTNLAWYQQKPGQAPRLLIFGASTRATGIPARFSGSGSGTEFTLTISSLQSEDFAVYYCQQYNKWPPLTFGGGTKVDIK

SEQ ID NO: 1131 - protein, 11 aa, Artificial Sequence
  source: /note="Description of Artificial Sequence: Synthetic light chain variable region CDR L1"
RASQSVGTNLA

SEQ ID NO: 1132 - DNA, 33 bp, Artificial Sequence
  source: /note="Description of Artificial Sequence: Synthetic light chain variable region CDR L1"
agggccagtcagagtgttggcaccaacttggcc

SEQ ID NO: 1133 - protein, 7 aa, Artificial Sequence
  source: /note="Description of Artificial Sequence: Synthetic light chain variable region CDR L2"
GASTRAT

SEQ ID NO: 1134 - DNA, 21 bp, Artificial Sequence
  source: /note="Description of Artificial Sequence: Synthetic light chain variable region CDR L2"
ggtgcctcaaccagggccact

SEQ ID NO: 1135 - protein, 10 aa, Artificial Sequence
  source: /note="Description of Artificial Sequence: Synthetic light chain variable region CDR L3"
QQYNKWPPLT

SEQ ID NO: 1136 - DNA, 30 bp, Artificial Sequence
  source: /note="Description of Artificial Sequence: Synthetic light chain variable region CDR L3"
cagcagtataataagtggcctccgctcact

SEQ ID NO: 1137 - DNA, 366 bp, Artificial Sequence
  source: /note="Description of Artificial Sequence: Synthetic heavy chain variable region"
caggtccagcttgtgcagtctgggggaggcttggtcaagcctggagggtccctgagactctcctgtgcagcctctggattcatcttcagtgactactacatggtctggatccgtcaggctccagggaaggggctggagtgggtttcatacattagtagtagcagcagatacataaactacgcagactctgtgaagggccgattcaccatctccagagacaacgccaagaactcactgtttctgcaaatgaacaccgtgagagccgaggacacggctgtgtattactgtgcgcaaggctggtattccgatttttggagtggtcccattaggatttggggccagggaaccctggtcaccgtctcctca

SEQ ID NO: 1138 - protein, 122 aa, Artificial Sequence
  source: /note="Description of Artificial Sequence: Synthetic heavy chain variable region"
QVQLVQSGGGLVKPGGSLRLSCAASGFIFSDYYMVWIRQAPGKGLEWVSYISSSSRYINYADSVKGRFTISRDNAKNSLFLQMNTVRAEDTAVYYCAQGWYSDFWSGPIRIWGQGTLVTVSS

SEQ ID NO: 1139 - protein, 9 aa, Artificial Sequence
  source: /note="Description of Artificial Sequence: Synthetic heavy chain variable region CDR H1"
FIFSDYYMV

SEQ ID NO: 1140 - DNA, 27 bp, Artificial Sequence
  source: /note="Description of Artificial Sequence: Synthetic heavy chain variable region CDR H1"
ttcatcttcagtgactactacatggtc

SEQ ID NO: 1141 - protein, 17 aa, Artificial Sequence
  source: /note="Description of Artificial Sequence: Synthetic heavy chain variable region CDR H2"
YISSSSRYINYADSVKG

SEQ ID NO: 1142 - DNA, 51 bp, Artificial Sequence
  source: /note="Description of Artificial Sequence: Synthetic heavy chain variable region CDR H2"
tacattagtagtagcagcagatacataaactacgcagactctgtgaagggc

SEQ ID NO: 1143 - protein, 15 aa, Artificial Sequence
  source: /note="Description of Artificial Sequence: Synthetic heavy chain variable region CDR H3"
AQGWYSDFWSGPIRI

SEQ ID NO: 1144 - DNA, 45 bp, Artificial Sequence
  source: /note="Description of Artificial Sequence: Synthetic heavy chain variable region CDR H3"
gcgcaaggctggtattccgatttttggagtggtcccattaggatt

SEQ ID NO: 1145 - DNA, 321 bp, Artificial Sequence
  source: /note="Description of Artificial Sequence: Synthetic light chain variable region"
gacatccagttgacccagtctccatcctccctgtctgcatctgtaggagacagagtcaccatcacttgccaggcgagtcaggacattagtaactctttaaattggtttcagcagaaacctgggaaagcccctaagctcctgatcttcgatgcatacaatctggaaacaggggtcccatcaaggttcagtggaagtggatctgggacagattttaccctcaccatcagcagcctgcagcctgaagatattgcaacatattactgtcagcagaatgataatctcgttctcactttcggcggagggaccaagctggagatcaaa

SEQ ID NO: 1146 - protein, 107 aa, Artificial Sequence
  source: /note="Description of Artificial Sequence: Synthetic light chain variable region"
DIQLTQSPSSLSASVGDRVTITCQASQDISNSLNWFQQKPGKAPKLLIFDAYNLETGVPSRFSGSGSGTDFTLTISSLQPEDIATYYCQQNDNLVLTFGGGTKLEIK

SEQ ID NO: 1147 - protein, 11 aa, Artificial Sequence
  source: /note="Description of Artificial Sequence: Synthetic light chain variable region CDR L1"
QASQDISNSLN

SEQ ID NO: 1148 - DNA, 33 bp, Artificial Sequence
  source: /note="Description of Artificial Sequence: Synthetic light chain variable region CDR L1"
caggcgagtcaggacattagtaactctttaaat

SEQ ID NO: 1149 - protein, 7 aa, Artificial Sequence
  source: /note="Description of Artificial Sequence: Synthetic light chain variable region CDR L2"
DAYNLET

SEQ ID NO: 1150 - DNA, 21 bp, Artificial Sequence
  source: /note="Description of Artificial Sequence: Synthetic light chain variable region CDR L2"
gatgcatacaatctggaaaca

SEQ ID NO: 1151 - protein, 9 aa, Artificial Sequence
  source: /note="Description of Artificial Sequence: Synthetic light chain variable region CDR L3"
QQNDNLVLT

SEQ ID NO: 1152 - DNA, 27 bp, Artificial Sequence
  source: /note="Description of Artificial Sequence: Synthetic light chain variable region CDR L3"
cagcagaatgataatctcgttctcact

SEQ ID NO: 1153 - DNA, 378 bp, Artificial Sequence
  source: /note="Description of Artificial Sequence: Synthetic heavy chain variable region"
caggtgcagctggtggagtctgggggaggcttggtacagcctggcaggtccctgagactctcctgtgcagcctctggattcacgtttgataattaccccatgcactggatccggcaagctccagggaagggcctggagtgggtctcaggtattagttggcatagtggaagcataggctatgcggactctgtgaagggccgattcaccatctccagagacaacgccaagaactccctgtatctgcaaatgaacagtctgagaactgaggacacggccttgtattactgtgcaaaagacgcccattactttgataatagcggtcactactactacggtctggacgtctggggccaagggaccacggtcaccgtctcctca

SEQ ID NO: 1154 - protein, 126 aa, Artificial Sequence
  source: /note="Description of Artificial Sequence: Synthetic heavy chain variable region"
QVQLVESGGGLVQPGRSLRLSCAASGFTFDNYPMHWIRQAPGKGLEWVSGISWHSGSIGYADSVKGRFTISRDNAKNSLYLQMNSLRTEDTALYYCAKDAHYFDNSGHYYYGLDVWGQGTTVTVSS

SEQ ID NO: 1155 - protein, 9 aa, Artificial Sequence
  source: /note="Description of Artificial Sequence: Synthetic heavy chain variable region CDR H1"
FTFDNYPMH

SEQ ID NO: 1156 - DNA, 27 bp, Artificial Sequence
  source: /note="Description of Artificial Sequence: Synthetic heavy chain variable region CDR H1"
ttcacgtttgataattaccccatgcac

SEQ ID NO: 1157 - protein, 17 aa, Artificial Sequence
  source: /note="Description of Artificial Sequence: Synthetic heavy chain variable region CDR H2"
GISWHSGSIGYADSVKG

SEQ ID NO: 1158 - DNA, 51 bp, Artificial Sequence
  source: /note="Description of Artificial Sequence: Synthetic heavy chain variable region CDR H2"
ggtattagttggcatagtggaagcataggctatgcggactctgtgaagggc

SEQ ID NO: 1159 - protein, 19 aa, Artificial Sequence
  source: /note="Description of Artificial Sequence: Synthetic heavy chain variable region CDR H3"
AKDAHYFDNSGHYYYGLDV

SEQ ID NO: 1160 - DNA, 57 bp, Artificial Sequence
  source: /note="Description of Artificial Sequence: Synthetic heavy chain variable region CDR H3"
gcaaaagacgcccattactttgataatagcggtcactactactacggtctggacgtc

SEQ ID NO: 1161 - DNA, 321 bp, Artificial Sequence
  source: /note="Description of Artificial Sequence: Synthetic light chain variable region"
gaaattgtgttgacacagtctccagccaccctgtctgtgtctccaggggaaagagccaccctctcctgcagggccagtcagaatattatcaacaacttagcctggtaccagcagaaacctggccaggctcccaggctcctcatctctggtgcatccaccagggccactggtatcccagccaggttcagtggcagtgggtctgggacagagttcactctcaccatcaccagcctgcagtctgaagattttgcagtttattactgtcagcagtataataactggccgctcactttcggcggagggaccaaagtggatatcaaa

SEQ ID NO: 1162 - protein, 107 aa, Artificial Sequence
  source: /note="Description of Artificial Sequence: Synthetic light chain variable region"
EIVLTQSPATLSVSPGERATLSCRASQNIINNLAWYQQKPGQAPRLLISGASTRATGIPARFSGSGSGTEFTLTITSLQSEDFAVYYCQQYNNWPLTFGGGTKVDIK

SEQ ID NO: 1163 - protein, 11 aa, Artificial Sequence
  source: /note="Description of Artificial Sequence: Synthetic light chain variable region CDR L1"
RASQNIINNLA

SEQ ID NO: 1164 - DNA, 33 bp, Artificial Sequence
  source: /note="Description of Artificial Sequence: Synthetic light chain variable region CDR L1"
agggccagtcagaatattatcaacaacttagcc

SEQ ID NO: 1165 - protein, 7 aa, Artificial Sequence
  source: /note="Description of Artificial Sequence: Synthetic light chain variable region CDR L2"
GASTRAT

SEQ ID NO: 1166 - DNA, 21 bp, Artificial Sequence
  source: /note="Description of Artificial Sequence: Synthetic light chain variable region CDR L2"
ggtgcatccaccagggccact

SEQ ID NO: 1167 - protein, 9 aa, Artificial Sequence
  source: /note="Description of Artificial Sequence: Synthetic light chain variable region CDR L3"
QQYNNWPLT

SEQ ID NO: 1168 - DNA, 27 bp, Artificial Sequence
  source: /note="Description of Artificial Sequence: Synthetic light chain variable region CDR L3"
cagcagtataataactggccgctcact

SEQ ID NO: 1169 - DNA, 387 bp, Artificial Sequence
  source: /note="Description of Artificial Sequence: Synthetic heavy chain variable region"
caggtccagctggtgcagtctgggggaggcttggtacagccagggcggtccctgagactctcctgtacagcctctggattcagcttcagtgattatggagtgacctgggtccgccaggctccagggaaggggctggagtggataggtttcgtcagaaccaagggttatggagggacaacagagtacgccgcgtctgtgagaggcagattcaccatctcaagagatgactccaaaagcgtcgcctatctacaattgaacagcctgaaagtcgaggatacagccgtctattactgttctggggcatcacggggcttttggagtgggccaacctactactactttggtatggacgtctggggccatgggaccacggtcactgtctcctca

SEQ ID NO: 1170 - protein, 129 aa, Artificial Sequence
  source: /note="Description of Artificial Sequence: Synthetic heavy chain variable region"
QVQLVQSGGGLVQPGRSLRLSCTASGFSFSDYGVTWVRQAPGKGLEWIGFVRTKGYGGTTEYAASVRGRFTISRDDSKSVAYLQLNSLKVEDTAVYYCSGASRGFWSGPTYYYFGMDVWGHGTTVTVSS

SEQ ID NO: 1171 - protein, 9 aa, Artificial Sequence
  source: /note="Description of Artificial Sequence: Synthetic heavy chain variable region CDR H1"
FSFSDYGVT

SEQ ID NO: 1172 - DNA, 27 bp, Artificial Sequence
  source: /note="Description of Artificial Sequence: Synthetic heavy chain variable region CDR H1"
ttcagcttcagtgattatggagtgacc

SEQ ID NO: 1173 - protein, 19 aa, Artificial Sequence
  source: /note="Description of Artificial Sequence: Synthetic heavy chain variable region CDR H2"
FVRTKGYGGTTEYAASVRG

SEQ ID NO: 1174 - DNA, 57 bp, Artificial Sequence
  source: /note="Description of Artificial Sequence: Synthetic heavy chain variable region CDR H2"
ttcgtcagaaccaagggttatggagggacaacagagtacgccgcgtctgtgagaggc

SEQ ID NO: 1175 - protein, 20 aa, Artificial Sequence
  source: /note="Description of Artificial Sequence: Synthetic heavy chain variable region CDR H3"
SGASRGFWSGPTYYYFGMDV

SEQ ID NO: 1176 - DNA, 60 bp, Artificial Sequence
  source: /note="Description of Artificial Sequence: Synthetic heavy chain variable region CDR H3"
tctggggcatcacggggcttttggagtgggccaacctactactactttggtatggacgtc

SEQ ID NO: 1177 - DNA, 330 bp, Artificial Sequence
  source: /note="Description of Artificial Sequence: Synthetic light chain variable region"
gaaattgtgttgacacagtctccactctccctggccgtcacccctggagagccggcctccatctcctgcaggtctagtcagagcctcctgcatggtaatggatacaactacttggattggtacctgcagaagccagggcagtctccacaactcctgatcttttggggttcttatcgggcctccggggcccctgacaggttcagtgccagtggatcaggctcagagtttacactgaaaatcagaagagtggaggctgaggatgtgggggtttattactgcatgcaacctctacaaacaacttttggccaggggaccaaagtggatatcaaa

SEQ ID NO: 1178 - protein, 110 aa, Artificial Sequence
  source: /note="Description of Artificial Sequence: Synthetic light chain variable region"
EIVLTQSPLSLAVTPGEPASISCRSSQSLLHGNGYNYLDWYLQKPGQSPQLLIFWGSYRASGAPDRFSASGSGSEFTLKIRRVEAEDVGVYYCMQPLQTTFGQGTKVDIK

SEQ ID NO: 1179 - protein, 16 aa, Artificial Sequence
  source: /note="Description of Artificial Sequence: Synthetic light chain variable region CDR L1"
RSSQSLLHGNGYNYLD

SEQ ID NO: 1180 - DNA, 48 bp, Artificial Sequence
  source: /note="Description of Artificial Sequence: Synthetic light chain variable region CDR L1"
aggtctagtcagagcctcctgcatggtaatggatacaactacttggat

SEQ ID NO: 1181 - protein, 7 aa, Artificial Sequence
  source: /note="Description of Artificial Sequence: Synthetic light chain variable region CDR L2"
WGSYRAS

SEQ ID NO: 1182 - DNA, 21 bp, Artificial Sequence
  source: /note="Description of Artificial Sequence: Synthetic light chain variable region CDR L2"
tggggttcttatcgggcctcc

SEQ ID NO: 1183 - protein, 7 aa, Artificial Sequence
  source: /note="Description of Artificial Sequence: Synthetic light chain variable region CDR L3"
MQPLQTT

SEQ ID NO: 1184 - DNA, 21 bp, Artificial Sequence
  source: /note="Description of Artificial Sequence: Synthetic light chain variable region CDR L3"
atgcaacctctacaaacaact

SEQ ID NO: 1185 - DNA, 360 bp, Artificial Sequence
  source: /note="Description of Artificial Sequence: Synthetic heavy chain variable region"
caggtccagctggtgcagtctggagcagaggtgaaaaagcccggggagtctctaaagatctcctgtaagggttctggatacacctttagaatgtattggatcggctgggcgcgcctgctgcccgggaaaggcctggagtggataggaatcatctatcctggtgactctgataccaggtacaacccgtccctccaaggccaggtcaccatgtcagtcgacaagtccatcaacaccgcctacctccagtggggaagcctgaaggcctcggacagcgccatttattactgtgcgagactgagattacatccccagagtggaatggacgtctggggccaagggaccctggtcaccgtctcctca

SEQ ID NO: 1186 - protein, 120 aa, Artificial Sequence
  source: /note="Description of Artificial Sequence: Synthetic heavy chain variable region"
QVQLVQSGAEVKKPGESLKISCKGSGYTFRMYWIGWARLLPGKGLEWIGIIYPGDSDTRYNPSLQGQVTMSVDKSINTAYLQWGSLKASDSAIYYCARLRLHPQSGMDVWGQGTLVTVSS

SEQ ID NO: 1187 - protein, 9 aa, Artificial Sequence
  source: /note="Description of Artificial Sequence: Synthetic heavy chain variable region CDR H1"
YTFRMYWIG

SEQ ID NO: 1188 - DNA, 27 bp, Artificial Sequence
  source: /note="Description of Artificial Sequence: Synthetic heavy chain variable region CDR H1"
tacacctttagaatgtattggatcggc

SEQ ID NO: 1189 - protein, 17 aa, Artificial Sequence
  source: /note="Description of Artificial Sequence: Synthetic heavy chain variable region CDR H2"
IIYPGDSDTRYNPSLQG

SEQ ID NO: 1190 - DNA, 51 bp, Artificial Sequence
  source: /note="Description of Artificial Sequence: Synthetic heavy chain variable region CDR H2"
atcatctatcctggtgactctgataccaggtacaacccgtccctccaaggc

SEQ ID NO: 1191 - protein, 13 aa, Artificial Sequence
  source: /note="Description of Artificial Sequence: Synthetic heavy chain variable region CDR H3"
ARLRLHPQSGMDV

SEQ ID NO: 1192 - DNA, 39 bp, Artificial Sequence
  source: /note="Description of Artificial Sequence: Synthetic heavy chain variable region CDR H3"
gcgagactgagattacatccccagagtggaatggacgtc

SEQ ID NO: 1193 - DNA, 330 bp, Artificial Sequence
  source: /note="Description of Artificial Sequence: Synthetic light chain variable region"
aattttatgctgactcagccccactctgtgtcggagtctccggggaagacggtagttatctcctgcacccgcagcagtggcagcattgccggctactatgtgcagtggtaccaacatcgcccgggcagttcccccactactgtgatatatgaggatgaccaaagaccctctggggtccctgatcggttctctgggtccgtcgacagctcctccaactctgcctccctcaccatctctggactgaagactgaggacgaggctgactactattgtcagtcctatgataacgccatttgggtgttcggcggagggaccaagctcaccgtccta

SEQ ID NO: 1194 - protein, 110 aa, Artificial Sequence
  source: /note="Description of Artificial Sequence: Synthetic light chain variable region"
NFMLTQPHSVSESPGKTVVISCTRSSGSIAGYYVQWYQHRPGSSPTTVIYEDDQRPSGVPDRFSGSVDSSSNSASLTISGLKTEDEADYYCQSYDNAIWVFGGGTKLTVL

SEQ ID NO: 1195 - protein, 13 aa, Artificial Sequence
  source: /note="Description of Artificial Sequence: Synthetic light chain variable region CDR L1"
TRSSGSIAGYYVQ

SEQ ID NO: 1196 - DNA, 39 bp, Artificial Sequence
  source: /note="Description of Artificial Sequence: Synthetic light chain variable region CDR L1"
acccgcagcagtggcagcattgccggctactatgtgcag

SEQ ID NO: 1197 - protein, 7 aa, Artificial Sequence
  source: /note="Description of Artificial Sequence: Synthetic light chain variable region CDR L2"
EDDQRPS

SEQ ID NO: 1198 - DNA, 21 bp, Artificial Sequence
  source: /note="Description of Artificial Sequence: Synthetic light chain variable region CDR L2"
gaggatgaccaaagaccctct

SEQ ID NO: 1199 - protein, 9 aa, Artificial Sequence
  source: /note="Description of Artificial Sequence: Synthetic light chain variable region CDR L3"
QSYDNAIWV

SEQ ID NO: 1200 - DNA, 27 bp, Artificial Sequence
  source: /note="Description of Artificial Sequence: Synthetic light chain variable region CDR L3"
cagtcctatgataacgccatttgggtg

SEQ ID NO: 1201 - DNA, 366 bp, Artificial Sequence
  source: /note="Description of Artificial Sequence: Synthetic heavy chain variable region"
caggtgcagcttgtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagtaaactacgcacagaagttccagggcagagtcacgattaccgcggacgaatccacgagcacagcctacatggagctgagcagtctgagatctgaggacacggccgtgtattactgtgcgagagatcgttcggtgacccctcgctactacggtatggacgtctggggccaagggaccacggtcaccgtctcctca

SEQ ID NO: 1202 - protein, 122 aa, Artificial Sequence
  source: /note="Description of Artificial Sequence: Synthetic heavy chain variable region"
QVQLVQSGAEVKKPGSSVKVSCKASGGTFSSYAISWVRQAPGQGLEWMGGIIPIFGTVNYAQKFQGRVTITADESTSTAYMELSSLRSEDTAVYYCARDRSVTPRYYGMDVWGQGTTVTVSS

SEQ ID NO: 1203 - protein, 9 aa, Artificial Sequence
  source: /note="Description of Artificial Sequence: Synthetic heavy chain variable region CDR H1"
GTFSSYAIS

SEQ ID NO: 1204 - DNA, 27 bp, Artificial Sequence
  source: /note="Description of Artificial Sequence: Synthetic heavy chain variable region CDR H1"
ggcaccttcagcagctatgctatcagc

SEQ ID NO: 1205 - protein, 17 aa, Artificial Sequence
  source: /note="Description of Artificial Sequence: Synthetic heavy chain variable region CDR H2"
GIIPIFGTVNYAQKFQG

SEQ ID NO: 1206 - DNA, 51 bp, Artificial Sequence
  source: /note="Description of Artificial Sequence: Synthetic heavy chain variable region CDR H2"
gggatcatccctatctttggtacagtaaactacgcacagaagttccagggc

SEQ ID NO: 1207 - protein, 15 aa, Artificial Sequence
  source: /note="Description of Artificial Sequence: Synthetic heavy chain variable region CDR H3"
ARDRSVTPRYYGMDV

SEQ ID NO: 1208 - DNA, 45 bp, Artificial Sequence
  source: /note="Description of Artificial Sequence: Synthetic heavy chain variable region CDR H3"
gcgagagatcgttcggtgacccctcgctactacggtatggacgtc

SEQ ID NO: 1209 - DNA, 324 bp, Artificial Sequence
  source: /note="Description of Artificial Sequence: Synthetic light chain variable region"
gaaattgtgatgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctccactcactttcggccctgggaccaagctggagatcaaa

SEQ ID NO: 1210 - protein, 108 aa, Artificial Sequence
  source: /note="Description of Artificial Sequence: Synthetic light chain variable region"
EIVMTQSPATLSLSPGERATLSCRASQSVSSYLAWYQQKPGQAPRLLIYDASNRATGIPARFSGSGSGTDFTLTISSLEPEDFAVYYCQHRSNWPPLTFGPGTKLEIK

SEQ ID NO: 1211 - protein, 11 aa, Artificial Sequence
  source: /note="Description of Artificial Sequence: Synthetic light chain variable region CDR L1"
RASQSVSSYLA

SEQ ID NO: 1212 - DNA, 33 bp, Artificial Sequence
  source: /note="Description of Artificial Sequence: Synthetic light chain variable region CDR L1"
agggccagtcagagtgttagcagctacttagcc

SEQ ID NO: 1213 - protein, 7 aa, Artificial Sequence
  source: /note="Description of Artificial Sequence: Synthetic light chain variable region CDR L2"
DASNRAT

SEQ ID NO: 1214 - DNA, 21 bp, Artificial Sequence
  source: /note="Description of Artificial Sequence: Synthetic light chain variable region CDR L2"
gatgcatccaacagggccact

SEQ ID NO: 1215 - protein, 10 aa, Artificial Sequence
  source: /note="Description of Artificial Sequence: Synthetic light chain variable region CDR L3"
QHRSNWPPLT

SEQ ID NO: 1216 - DNA, 30 bp, Artificial Sequence
  source: /note="Description of Artificial Sequence: Synthetic light chain variable region CDR L3"
cagcaccgtagcaactggcctccactcact

SEQ ID NO: 1217 - DNA, 357 bp, Artificial Sequence; identical to SEQ ID NO: 881
  source: /note="Description of Artificial Sequence: Synthetic heavy chain variable region"

SEQ ID NO: 1218 - protein, 119 aa, Artificial Sequence; identical to SEQ ID NO: 882
  source: /note="Description of Artificial Sequence: Synthetic heavy chain variable region"

SEQ ID NO: 1219 - protein, 9 aa, Artificial Sequence
  source: /note="Description of Artificial Sequence: Synthetic heavy chain variable region CDR H1"
FTISGYNMF

SEQ ID NO: 1220 - DNA, 27 bp, Artificial Sequence
  source: /note="Description of Artificial Sequence: Synthetic heavy chain variable region CDR H1"
ttcaccatcagtggttataacatgttc

SEQ ID NO: 1221 - protein, 17 aa, Artificial Sequence
  source: /note="Description of Artificial Sequence: Synthetic heavy chain variable region CDR H2"
SITAGSSYLNYADSVKG

SEQ ID NO: 1222 - DNA, 51 bp, Artificial Sequence; identical to SEQ ID NO: 326
  source: /note="Description of Artificial Sequence: Synthetic heavy chain variable region CDR H2"

SEQ ID NO: 1223 - protein, 12 aa, Artificial Sequence
  source: /note="Description of Artificial Sequence: Synthetic heavy chain variable region CDR H3"
ARAPLLPAMMDL

SEQ ID NO: 1224 - DNA, 36 bp, Artificial Sequence; identical to SEQ ID NO: 328
  source: /note="Description of Artificial Sequence: Synthetic heavy chain variable region CDR H3"

SEQ ID NO: 1225 - DNA, 333 bp, Artificial Sequence
  source: /note="Description of Artificial Sequence: Synthetic light chain variable region"
cagtctgtgctgacgcagccgccctcagtgtctggggccccagggcagagggtcaccatctcctgcactgggagcagctccaacatcggggcaggttatgatgtacactggtaccagcaacttccaggaacagcccccaaactcctcatctatactaacaacaatcggccctcaggggtccctgaccgattctctggctccaagtctggcacctcagcctccctggccatcactgggctccaggctgaggatgaggctgactattactgccagtcctatgacagaagcctgaatggttatgtcttcggaactgggaccaaggtcaccgtccta

SEQ ID NO: 1226 - protein, 111 aa, Artificial Sequence
  source: /note="Description of Artificial Sequence: Synthetic light chain variable region"
QSVLTQPPSVSGAPGQRVTISCTGSSSNIGAGYDVHWYQQLPGTAPKLLIYTNNNRPSGVPDRFSGSKSGTSASLAITGLQAEDEADYYCQSYDRSLNGYVFGTGTKVTVL

SEQ ID NO: 1227 - protein, 14 aa, Artificial Sequence
  source: /note="Description of Artificial Sequence: Synthetic light chain variable region CDR L1"
TGSSSNIGAGYDVH

SEQ ID NO: 1228 - DNA, 42 bp, Artificial Sequence; identical to SEQ ID NO: 60
  source: /note="Description of Artificial Sequence: Synthetic light chain variable region CDR L1"

SEQ ID NO: 1229 - protein, 7 aa, Artificial Sequence
  source: /note="Description of Artificial Sequence: Synthetic light chain variable region CDR L2"
TNNNRPS

SEQ ID NO: 1230 - DNA, 21 bp, Artificial Sequence
  source: /note="Description of Artificial Sequence: Synthetic light chain variable region CDR L2"
actaacaacaatcggccctca

SEQ ID NO: 1231 - protein, 11 aa, Artificial Sequence
  source: /note="Description of Artificial Sequence: Synthetic light chain variable region CDR L3"
QSYDRSLNGYV

SEQ ID NO: 1232 - DNA, 33 bp, Artificial Sequence; identical to SEQ ID NO: 336
  source: /note="Description of Artificial Sequence: Synthetic light chain variable region CDR L3"

SEQ ID NO: 1233 - DNA, 366 bp, Artificial Sequence
  source: /note="Description of Artificial Sequence: Synthetic heavy chain variable region"
gaggtgcagctggtggagtctggggctgaggtgaagaagcctgggtcctcggtgaaggtctcctgcaaggcttctgcagacaccttcagcagttatgctatcagctgggtgcggcaggcccctggacaagggcttgagtggatgggagggatcctccctatccttggtacagcaaactccgcacagaagttccggggcagagtcacgtttaccgcggacgaatccacgaccacagcctacatggaactgagcagcctgagatctgaggacacggccgtctattactgcgcgaggcttgctggaccacggtggccggggtacggtatggacgtctggggccaagggaccctggtcaccgtctcctca

SEQ ID NO: 1234 - protein, 122 aa, Artificial Sequence
  source: /note="Description of Artificial Sequence: Synthetic heavy chain variable region"
EVQLVESGAEVKKPGSSVKVSCKASADTFSSYAISWVRQAPGQGLEWMGGILPILGTANSAQKFRGRVTFTADESTTTAYMELSSLRSEDTAVYYCARLAGPRWPGYGMDVWGQGTLVTVSS

SEQ ID NO: 1235 - protein, 9 aa, Artificial Sequence
  source: /note="Description of Artificial Sequence: Synthetic heavy chain variable region CDR H1"
DTFSSYAIS

SEQ ID NO: 1236 - DNA, 27 bp, Artificial Sequence
  source: /note="Description of Artificial Sequence: Synthetic heavy chain variable region CDR H1"
gacaccttcagcagttatgctatcagc

SEQ ID NO: 1237 - protein, 17 aa, Artificial Sequence
  source: /note="Description of Artificial Sequence: Synthetic heavy chain variable region CDR H2"
GILPILGTANSAQKFRG

SEQ ID NO: 1238 - DNA, 51 bp, Artificial Sequence
  source: /note="Description of Artificial Sequence: Synthetic heavy chain variable region CDR H2"
gggatcctccctatccttggtacagcaaactccgcacagaagttccggggc

SEQ ID NO: 1239 - protein, 15 aa, Artificial Sequence
  source: /note="Description of Artificial Sequence: Synthetic heavy chain variable region CDR H3"
ARLAGPRWPGYGMDV

SEQ ID NO: 1240 - DNA, 45 bp, Artificial Sequence
  source: /note="Description of Artificial Sequence: Synthetic heavy chain variable region CDR H3"
gcgaggcttgctggaccacggtggccggggtacggtatggacgtc

SEQ ID NO: 1241 - DNA, 321 bp, Artificial Sequence
  source: /note="Description of Artificial Sequence: Synthetic light chain variable region"
gacatccagttgacccagtctccatccttcctgtctgcttctgtaggagacagagtcaccatcacttgccgggccagtcagggcattagcagttatttagcctggtatcaacagaaaccagggaaagcccctaaactcctgatctatgctgcatccactttgcaaagtggggtcccatcaaggttcagcggcagtggatctgggacagaattcactctcacaatcagcagcctgcagcctgaagattttgcaacttattactgtcagcagcttaacagtttccccctcaccttcggcggagggaccaaggtggaaatcaaa

SEQ ID NO: 1242 - protein, 107 aa, Artificial Sequence
  source: /note="Description of Artificial Sequence: Synthetic light chain variable region"
DIQLTQSPSFLSASVGDRVTITCRASQGISSYLAWYQQKPGKAPKLLIYAASTLQSGVPSRFSGSGSGTEFTLTISSLQPEDFATYYCQQLNSFPLTFGGGTKVEIK

SEQ ID NO: 1243 - protein, 11 aa, Artificial Sequence
  source: /note="Description of Artificial Sequence: Synthetic light chain variable region CDR L1"
RASQGISSYLA

SEQ ID NO: 1244 - DNA, 33 bp, Artificial Sequence
  source: /note="Description of Artificial Sequence: Synthetic light chain variable region CDR L1"
cgggccagtcagggcattagcagttatttagcc

SEQ ID NO: 1245 - protein, 7 aa, Artificial Sequence
  source: /note="Description of Artificial Sequence: Synthetic light chain variable region CDR L2"
AASTLQS

SEQ ID NO: 1246 - DNA, 21 bp, Artificial Sequence
  source: /note="Description of Artificial Sequence: Synthetic light chain variable region CDR L2"
gctgcatccactttgcaaagt

SEQ ID NO: 1247 - protein, 9 aa, Artificial Sequence
  source: /note="Description of Artificial Sequence: Synthetic light chain variable region CDR L3"
QQLNSFPLT

SEQ ID NO: 1248 - DNA, 27 bp, Artificial Sequence
  source: /note="Description of Artificial Sequence: Synthetic light chain variable region CDR L3"
cagcagcttaacagtttccccctcacc

SEQ ID NO: 1249 - DNA, 354 bp, Artificial Sequence
  source: /note="Description of Artificial Sequence: Synthetic heavy chain variable region"
caggtccagctggtgcagtctggggctgaggtgacgaagcctggggcctcagtgagggtctcctgcaaattttccgcatacaccctctctgcattatccattcactgggtgcgacaggctcctggaaaaggccttgagtggatgggagcttttgatcctgaggatggtgagccaatctactcacagcatttccagggcagagtcaccatgaccgaggacacttctacacagacagcctacatggagctgaacagcctgagatctgaggacacggccgtttattactgttcatccgtaggaccagcggggtggttcgacccctggggccagggaaccctggtcaccgtctcctca

SEQ ID NO: 1250 - protein, 118 aa, Artificial Sequence
  source: /note="Description of Artificial Sequence: Synthetic heavy chain variable region"
QVQLVQSGAEVTKPGASVRVSCKFSAYTLSALSIHWVRQAPGKGLEWMGAFDPEDGEPIYSQHFQGRVTMTEDTSTQTAYMELNSLRSEDTAVYYCSSVGPAGWFDPWGQGTLVTVSS

SEQ ID NO: 1251 - protein, 9 aa, Artificial Sequence
  source: /note="Description of Artificial Sequence: Synthetic heavy chain variable region CDR H1"
YTLSALSIH

SEQ ID NO: 1252 - DNA, 27 bp, Artificial Sequence
  source: /note="Description of Artificial Sequence: Synthetic heavy chain variable region CDR H1"
tacaccctctctgcattatccattcac

SEQ ID NO: 1253 - protein, 17 aa, Artificial Sequence
  source: /note="Description of Artificial Sequence: Synthetic heavy chain variable region CDR H2"
AFDPEDGEPIYSQHFQG

SEQ ID NO: 1254 - DNA, 51 bp, Artificial Sequence
  source: /note="Description of Artificial Sequence: Synthetic heavy chain variable region CDR H2"
gcttttgatcctgaggatggtgagccaatctactcacagcatttccagggc

SEQ ID NO: 1255 - protein, 11 aa, Artificial Sequence
  source: /note="Description of Artificial Sequence: Synthetic heavy chain variable region CDR H3"
SSVGPAGWFDP

SEQ ID NO: 1256 - DNA, 33 bp, Artificial Sequence
  source: /note="Description of Artificial Sequence: Synthetic heavy chain variable region CDR H3"
tcatccgtaggaccagcggggtggttcgacccc

SEQ ID NO: 1257 - DNA, 321 bp, Artificial Sequence
  source: /note="Description of Artificial Sequence: Synthetic light chain variable region"
gacatccggttgacccagtctccatcctccctgtctgcatctgtgggagacagagtcagcatcacttgccgggcaagtcagagcattagcagctatttacattggtatcaacaaaaaccagggaaagcccctaagctcctgatctatgctgcatccagtttgcaaagtggggtcccatcaaggttcagtggcagtggatctgggtcagatttcactctcaccatcagcagtctgcaacctgaagattttgcaacttactactgtcaccagagttacattcccccattcactttcggccctgggaccaagctggagatcaaa

SEQ ID NO: 1258 - protein, 107 aa, Artificial Sequence
  source: /note="Description of Artificial Sequence: Synthetic light chain variable region"
DIRLTQSPSSLSASVGDRVSITCRASQSISSYLHWYQQKPGKAPKLLIYAASSLQSGVPSRFSGSGSGSDFTLTISSLQPEDFATYYCHQSYIPPFTFGPGTKLEIK

SEQ ID NO: 1259 - protein, 11 aa, Artificial Sequence
  source: /note="Description of Artificial Sequence: Synthetic light chain variable region CDR L1"
RASQSISSYLH

SEQ ID NO: 1260 - DNA, 33 bp, Artificial Sequence
  source: /note="Description of Artificial Sequence: Synthetic light chain variable region CDR L1"
cgggcaagtcagagcattagcagctatttacat

SEQ ID NO: 1261 - protein, 7 aa, Artificial Sequence
  source: /note="Description of Artificial Sequence: Synthetic light chain variable region CDR L2"
AASSLQS

SEQ ID NO: 1262 - DNA, 21 bp, Artificial Sequence
  source: /note="Description of Artificial Sequence: Synthetic light chain variable region CDR L2"
gctgcatccagtttgcaaagt

SEQ ID NO: 1263 - protein, 9 aa, Artificial Sequence
  source: /note="Description of Artificial Sequence: Synthetic light chain variable region CDR L3"
HQSYIPPFT

SEQ ID NO: 1264 - DNA, 27 bp, Artificial Sequence
  source: /note="Description of Artificial Sequence: Synthetic light chain variable region CDR L3"
caccagagttacattcccccattcact

SEQ ID NO: 1265 - DNA, 360 bp, Artificial Sequence
  source: /note="Description of Artificial Sequence: Synthetic heavy chain variable region"
gaggtgcagctggtggagtctgggggaggcctggtcaagcctggggggtccctgagactctcctgtgcagcctctggattcaccatcactagctatggcatgaactgggtccgccaggctccaggaaaggggctggagtgggtctcatccattagtagtagtagtagtttcatacactatggagactcagtgaagggtcgattcaccatctccagagacaacgccaagaactcactgtatctgcaaatgaacagcctgagagccggggacacggctgtatactactgtgtgagagactcgggccaccaggactaccgcggggactactggggccagggaaccctggtcaccgtctcctca

SEQ ID NO: 1266 - protein, 120 aa, Artificial Sequence
  source: /note="Description of Artificial Sequence: Synthetic heavy chain variable region"
EVQLVESGGGLVKPGGSLRLSCAASGFTITSYGMNWVRQAPGKGLEWVSSISSSSSFIHYGDSVKGRFTISRDNAKNSLYLQMNSLRAGDTAVYYCVRDSGHQDYRGDYWGQGTLVTVSS

SEQ ID NO: 1267 - protein, 9 aa, Artificial Sequence
  source: /note="Description of Artificial Sequence: Synthetic heavy chain variable region CDR H1"
FTITSYGMN

SEQ ID NO: 1268 - DNA, 27 bp, Artificial Sequence
  source: /note="Description of Artificial Sequence: Synthetic heavy chain variable region CDR H1"
ttcaccatcactagctatggcatgaac

SEQ ID NO: 1269 - protein, 17 aa, Artificial Sequence
  source: /note="Description of Artificial Sequence: Synthetic heavy chain variable region CDR H2"
SISSSSSFIHYGDSVKG

SEQ ID NO: 1270 - DNA, 51 bp, Artificial Sequence
  source: /note="Description of Artificial Sequence: Synthetic heavy chain variable region CDR H2"
tccattagtagtagtagtagtttcatacactatggagactcagtgaagggt

SEQ ID NO: 1271 - protein, 13 aa, Artificial Sequence
  source: /note="Description of Artificial Sequence: Synthetic heavy chain variable region CDR H3"
VRDSGHQDYRGDY

SEQ ID NO: 1272 - DNA, 39 bp, Artificial Sequence
  source: /note="Description of Artificial Sequence: Synthetic heavy chain variable region CDR H3"
gtgagagactcgggccaccaggactaccgcggggactac

SEQ ID NO: 1273 - DNA, 333 bp, Artificial Sequence
  source: /note="Description of Artificial Sequence: Synthetic light chain variable region"
cagtctgtggtgacgcagccgccctcagtgtctggggccccagggcagagggtctccatctcctgcactgggagcagctccaacatcggggcaggttatgatgtacactggtaccagcagcttccaggaacagcccccaaactcctcatctatactaacaacaatcggccctcaggggtccctgaccgattctctggctccaagtctggcacctcagcctccctggccatcaatgggctccaggctgaggatgaggctgattattactgccagtcctatgacaggagcctgagtggttgggtgttcggcggagggaccaagctcaccgtccta

SEQ ID NO: 1274 - protein, 111 aa, Artificial Sequence
  source: /note="Description of Artificial Sequence: Synthetic light chain variable region"
QSVVTQPPSVSGAPGQRVSISCTGSSSNIGAGYDVHWYQQLPGTAPKLLIYTNNNRPSGVPDRFSGSKSGTSASLAINGLQAEDEADYYCQSYDRSLSGWVFGGGTKLTVL

SEQ ID NO: 1275 - protein, 14 aa, Artificial Sequence
  source: /note="Description of Artificial Sequence: Synthetic light chain variable region CDR L1"
TGSSSNIGAGYDVH

SEQ ID NO: 1276 - DNA, 42 bp, Artificial Sequence; identical to SEQ ID NO: 60
  source: /note="Description of Artificial Sequence: Synthetic light chain variable region CDR L1"

SEQ ID NO: 1277 - protein, 7 aa, Artificial Sequence
  source: /note="Description of Artificial Sequence: Synthetic light chain variable region CDR L2"
TNNNRPS

SEQ ID NO: 1278 - DNA, 21 bp, Artificial Sequence
  source: /note="Description of Artificial Sequence: Synthetic light chain variable region CDR L2"
actaacaacaatcggccctca

SEQ ID NO: 1279 - protein, 11 aa, Artificial Sequence
  source: /note="Description of Artificial Sequence: Synthetic light chain variable region CDR L3"
QSYDRSLSGWV

SEQ ID NO: 1280 - DNA, 33 bp, Artificial Sequence
  source: /note="Description of Artificial Sequence: Synthetic light chain variable region CDR L3"
cagtcctatgacaggagcctgagtggttgggtg

SEQ ID NO: 1281 - DNA, 378 bp, Artificial Sequence
  source: /note="Description of Artificial Sequence: Synthetic heavy chain variable region"
caggtgcagctggtggagtctggtcctgcgttggtgaaacccacacagaccctcacactgacctgcgccttctctgggttctcactcaccactcgtgggatgtctgtgagctggatccgtcagcccccagggaaggccctggagtggcttgcacgcattgattgggatgatgataaatactacagcacctctctgaagaccaggctcaccatctccaaggacacctccaaaaaccaggtggtcctcacaatgagcaacatggaccctgtggacacagccacgtattactgtgcacgggcgtctctctatgatagtggtggctattacctttttttctttgactactggggccagggaaccctggtcaccgtctcctca

SEQ ID NO: 1282 - protein, 126 aa, Artificial Sequence
  source: /note="Description of Artificial Sequence: Synthetic heavy chain variable region"
QVQLVESGPALVKPTQTLTLTCAFSGFSLTTRGMSVSWIRQPPGKALEWLARIDWDDDKYYSTSLKTRLTISKDTSKNQVVLTMSNMDPVDTATYYCARASLYDSGGYYLFFFDYWGQGTLVTVSS

SEQ ID NO: 1283 - protein, 11 aa, Artificial Sequence
  source: /note="Description of Artificial Sequence: Synthetic heavy chain variable region CDR H1"
FSLTTRGMSVS

SEQ ID NO: 1284 - DNA, 33 bp, Artificial Sequence
  source: /note="Description of Artificial Sequence: Synthetic heavy chain variable region CDR H1"
ttctcactcaccactcgtgggatgtctgtgagc

SEQ ID NO: 1285 - protein, 16 aa, Artificial Sequence
  source: /note="Description of Artificial Sequence: Synthetic heavy chain variable region CDR H2"
RIDWDDDKYYSTSLKT

SEQ ID NO: 1286 - DNA, 48 bp, Artificial Sequence
  source: /note="Description of Artificial Sequence: Synthetic heavy chain variable region CDR H2"
cgcattgattgggatgatgataaatactacagcacctctctgaagacc

SEQ ID NO: 1287 - protein, 18 aa, Artificial Sequence
  source: /note="Description of Artificial Sequence: Synthetic heavy chain variable region CDR H3"
ARASLYDSGGYYLFFFDY

SEQ ID NO: 1288 - DNA, 54 bp, Artificial Sequence
  source: /note="Description of Artificial Sequence: Synthetic heavy chain variable region CDR H3"
gcacgggcgtctctctatgatagtggtggctattacctttttttctttgactac

SEQ ID NO: 1289 - DNA, 321 bp, Artificial Sequence
  source: /note="Description of Artificial Sequence: Synthetic light chain variable region"
gatattgtgatgactcagtctccatcctccctgtctgcatctgttggagacagagtcaccatcacttgccgggcaagccagagcattggcagttatttaaattggtatcagcagaaaccagggaaagtcccgaaactcctgatctatgctgcatccaatttgcaaggtggggtcccatcaaggtttcgtggcagtggatctgggacagatttcactctcaccatcagcaatctgcaacctgaagattttgcaagttactactgtcaactgagttacagtagcctttggacgttcggccaagggaccaaggtggaaatcaaa

SEQ ID NO: 1290 - protein, 107 aa, Artificial Sequence
  source: /note="Description of Artificial Sequence: Synthetic light chain variable region"
DIVMTQSPSSLSASVGDRVTITCRASQSIGSYLNWYQQKPGKVPKLLIYAASNLQGGVPSRFRGSGSGTDFTLTISNLQPEDFASYYCQLSYSSLWTFGQGTKVEIK

SEQ ID NO: 1291 - protein, 11 aa, Artificial Sequence
  source: /note="Description of Artificial Sequence: Synthetic light chain variable region CDR L1"
RASQSIGSYLN

SEQ ID NO: 1292 - DNA, 33 bp, Artificial Sequence
  source: /note="Description of Artificial Sequence: Synthetic light chain variable region CDR L1"
cgggcaagccagagcattggcagttatttaaat

SEQ ID NO: 1293 - protein, 7 aa, Artificial Sequence
  source: /note="Description of Artificial Sequence: Synthetic light chain variable region CDR L2"
AASNLQG

SEQ ID NO: 1294 - DNA, 21 bp, Artificial Sequence
  source: /note="Description of Artificial Sequence: Synthetic light chain variable region CDR L2"
gctgcatccaatttgcaaggt

SEQ ID NO: 1295 - protein, 9 aa, Artificial Sequence
  source: /note="Description of Artificial Sequence: Synthetic light chain variable region CDR L3"
QLSYSSLWT

SEQ ID NO: 1296 - DNA, 27 bp, Artificial Sequence
  source: /note="Description of Artificial Sequence: Synthetic light chain variable region CDR L3"
caactgagttacagtagcctttggacg

SEQ ID NO: 1297 - DNA, 351 bp, Artificial Sequence
  source: /note="Description of Artificial Sequence: Synthetic heavy chain variable region"
caggtgcagctggtggagtctgggggaggcgtggtccagcctgggaggtccctgagagtctcctgtgcagcctctggatttgacttcagtaactatgccatgcactgggtccgccaggctccaggcaaggggctggagtgggtggcacttatatcctatgatggaaataataaagtctatgcagactccgtgaagggccgattcaccgtctccagagacaattccaaaaacacactttatctgcaaatgaacagcctgagacctgaagacacggctgtgatttactgtgcgaaagatggctatctggctcctgacttctggggccagggaaccctggtcaccgtctcctca

SEQ ID NO: 1298 - protein, 117 aa, Artificial Sequence
  source: /note="Description of Artificial Sequence: Synthetic heavy chain variable region"
QVQLVESGGGVVQPGRSLRVSCAASGFDFSNYAMHWVRQAPGKGLEWVALISYDGNNKVYADSVKGRFTVSRDNSKNTLYLQMNSLRPEDTAVIYCAKDGYLAPDFWGQGTLVTVSS

SEQ ID NO: 1299 - protein, 9 aa, Artificial Sequence
  source: /note="Description of Artificial Sequence: Synthetic heavy chain variable region CDR H1"
FDFSNYAMH

SEQ ID NO: 1300 - DNA, 27 bp, Artificial Sequence
  source: /note="Description of Artificial Sequence: Synthetic heavy chain variable region CDR H1"
tttgacttcagtaactatgccatgcac

SEQ ID NO: 1301 - protein, 17 aa, Artificial Sequence
  source: /note="Description of Artificial Sequence: Synthetic heavy chain variable region CDR H2"
LISYDGNNKVYADSVKG

SEQ ID NO: 1302 - DNA, 51 bp, Artificial Sequence
  source: /note="Description of Artificial Sequence: Synthetic heavy chain variable region CDR H2"
cttatatcctatgatggaaataataaagtctatgcagactccgtgaagggc

SEQ ID NO: 1303 - protein, 10 aa, Artificial Sequence
  source: /note="Description of Artificial Sequence: Synthetic heavy chain variable region CDR H3"
AKDGYLAPDF

SEQ ID NO: 1304 - DNA, 30 bp, Artificial Sequence
  source: /note="Description of Artificial Sequence: Synthetic heavy chain variable region CDR H3"
gcgaaagatggctatctggctcctgacttc

SEQ ID NO: 1305 - DNA, 330 bp, Artificial Sequence
  source: /note="Description of Artificial Sequence: Synthetic light chain variable region"
cagtcagtcctgactcagcctgcctccgtgtctgggtctcctggacagtcgatcatcatctcctgcactggaaccagcagtgacgttggtgaatatgactatgtctcctggtaccaacaccacccacacaaagcccccaaactcataatttatgaggtcagtaatcggccctcaggggtttctaatcgcttctctggctccaagtctggcaacacggcctccctgaccatctctgggctccaggctgaggacgaggctgattattactgcagttcctacacaagcagtagcggtcaagccttcggaactgggaccaaggtcaccgtccta

SEQ ID NO: 1306 - protein, 110 aa, Artificial Sequence
  source: /note="Description of Artificial Sequence: Synthetic light chain variable region"
QSVLTQPASVSGSPGQSIIISCTGTSSDVGEYDYVSWYQHHPHKAPKLIIYEVSNRPSGVSNRFSGSKSGNTASLTISGLQAEDEADYYCSSYTSSSGQAFGTGTKVTVL

SEQ ID NO: 1307 - protein, 14 aa, Artificial Sequence
  source: /note="Description of Artificial Sequence: Synthetic light chain variable region CDR L1"
TGTSSDVGEYDYVS

SEQ ID NO: 1308 - DNA, 42 bp, Artificial Sequence
  source: /note="Description of Artificial Sequence: Synthetic light chain variable region CDR L1"
actggaaccagcagtgacgttggtgaatatgactatgtctcc

SEQ ID NO: 1309 - protein, 7 aa, Artificial Sequence
  source: /note="Description of Artificial Sequence: Synthetic light chain variable region CDR L2"
EVSNRPS

SEQ ID NO: 1310 - DNA, 21 bp, Artificial Sequence
  source: /note="Description of Artificial Sequence: Synthetic light chain variable region CDR L2"
gaggtcagtaatcggccctca

SEQ ID NO: 1311 - protein, 10 aa, Artificial Sequence
  source: /note="Description of Artificial Sequence: Synthetic light chain variable region CDR L3"
SSYTSSSGQA

SEQ ID NO: 1312 - DNA, 30 bp, Artificial Sequence
  source: /note="Description of Artificial Sequence: Synthetic light chain variable region CDR L3"
agttcctacacaagcagtagcggtcaagcc

SEQ ID NO: 1313 - DNA, 372 bp, Artificial Sequence
  source: /note="Description of Artificial Sequence: Synthetic heavy chain variable region"
gaggtgcagctggtggagtctggaggaggcttgatccagcctggggggtccctgagactctcctgtgcagcctctgggttcaccgtcagtagcaagtacatgagctgggtccgccaggctccagggaaggggctggagtgggtctcaattatttatagtggtggtagcacataccacgcagactccgtgaagggccgattcaccatctccagagacaactccaagaacacactgtatcttcaaatgaacagcctgagagccgaggacacggccgtgtattactgtgcgagagatgattacgatttttggagtggcaacggcccaccggagatggccgtctggggccaggggaccacggtcaccgtctcctca

SEQ ID NO: 1314 - protein, 124 aa, Artificial Sequence
  source: /note="Description of Artificial Sequence: Synthetic heavy chain variable region"
EVQLVESGGGLIQPGGSLRLSCAASGFTVSSKYMSWVRQAPGKGLEWVSIIYSGGSTYHADSVKGRFTISRDNSKNTLYLQMNSLRAEDTAVYYCARDDYDFWSGNGPPEMAVWGQGTTVTVSS

SEQ ID NO: 1315 - protein, 9 aa, Artificial Sequence
  source: /note="Description of Artificial Sequence: Synthetic heavy chain variable region CDR H1"
FTVSSKYMS

SEQ ID NO: 1316 - DNA, 27 bp, Artificial Sequence
  source: /note="Description of Artificial Sequence: Synthetic heavy chain variable region CDR H1"
ttcaccgtcagtagcaagtacatgagc

SEQ ID NO: 1317 - protein, 16 aa, Artificial Sequence
  source: /note="Description of Artificial Sequence: Synthetic heavy chain variable region CDR H2"
IIYSGGSTYHADSVKG

SEQ ID NO: 1318 - DNA, 48 bp, Artificial Sequence
  source: /note="Description of Artificial Sequence: Synthetic heavy chain variable region CDR H2"
attatttatagtggtggtagcacataccacgcagactccgtgaagggc

SEQ ID NO: 1319 - protein, 18 aa, Artificial Sequence
  source: /note="Description of Artificial Sequence: Synthetic heavy chain variable region CDR H3"
ARDDYDFWSGNGPPEMAV

SEQ ID NO: 1320 - DNA, 54 bp, Artificial Sequence
  source: /note="Description of Artificial Sequence: Synthetic heavy chain variable region CDR H3"
gcgagagatgattacgatttttggagtggcaacggcccaccggagatggccgtc

SEQ ID NO: 1321 - DNA, 321 bp, Artificial Sequence
  source: /note="Description of Artificial Sequence: Synthetic light chain variable region"
gacatccggatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgagacagatttcactctcaccatcagcagcctgcagcctgaagatgttgcaacttattactgtcaaaagtataacagtgtccctctgacgttcggccaagggaccaaggtggaaatcaaa

SEQ ID NO: 1322 - protein, 107 aa, Artificial Sequence
  source: /note="Description of Artificial Sequence: Synthetic light chain variable region"
DIRMTQSPSSLSASVGDRVTITCRASQGISNYLAWYQQKPGKVPKLLIYAASTLQSGVPSRFSGSGSETDFTLTISSLQPEDVATYYCQKYNSVPLTFGQGTKVEIK

SEQ ID NO: 1323 - protein, 11 aa, Artificial Sequence
  source: /note="Description of Artificial Sequence: Synthetic light chain variable region CDR L1"
RASQGISNYLA

SEQ ID NO: 1324 - DNA, 33 bp, Artificial Sequence
  source: /note="Description of Artificial Sequence: Synthetic light chain variable region CDR L1"
cgggcgagtcagggcattagcaattatttagcc

SEQ ID NO: 1325 - protein, 7 aa, Artificial Sequence
  source: /note="Description of Artificial Sequence: Synthetic light chain variable region CDR L2"
AASTLQS

SEQ ID NO: 1326 - DNA, 21 bp, Artificial Sequence
  source: /note="Description of Artificial Sequence: Synthetic light chain variable region CDR L2"
gctgcatccactttgcaatca

SEQ ID NO: 1327 - protein, 9 aa, Artificial Sequence
  source: /note="Description of Artificial Sequence: Synthetic light chain variable region CDR L3"
QKYNSVPLT

SEQ ID NO: 1328 - DNA, 27 bp, Artificial Sequence
  source: /note="Description of Artificial Sequence: Synthetic light chain variable region CDR L3"
caaaagtataacagtgtccctctgacg

SEQ ID NO: 1329 - DNA, 369 bp, Artificial Sequence
  source: /note="Description of Artificial Sequence: Synthetic heavy chain variable region"
caggtccagctggtgcagtctggagcagaggtgaaaaagcccggggagtctctgaagatctcctgtaagacttctggatacagatttaccaattactggatcggctgggtgcgccagatgcccgggaaaggcctggagtggatggggatcatctatcctggtgactctgatgccagatacagcccgtccttccaaggccaggtcaccttctcagccgacaagtccatcagcaccgcctacctgcactggagcagcctgaaggcctcggacaccgccatgtattactgtgcgagacaagatgacagtggctgggccgacttctttccctttgactactggggccagggaaccctggtcaccgtctcctca

SEQ ID NO: 1330 - protein, 123 aa, Artificial Sequence
  source: /note="Description of Artificial Sequence: Synthetic heavy chain variable region"
QVQLVQSGAEVKKPGESLKISCKTSGYRFTNYWIGWVRQMPGKGLEWMGIIYPGDSDARYSPSFQGQVTFSADKSISTAYLHWSSLKASDTAMYYCARQDDSGWADFFPFDYWGQGTLVTVSS

SEQ ID NO: 1331 - protein, 9 aa, Artificial Sequence
  source: /note="Description of Artificial Sequence: Synthetic heavy chain variable region CDR H1"
YRFTNYWIG

SEQ ID NO: 1332 - DNA, 27 bp, Artificial Sequence
  source: /note="Description of Artificial Sequence: Synthetic heavy chain variable region CDR H1"
tacagatttaccaattactggatcggc

SEQ ID NO: 1333 - protein, 17 aa, Artificial Sequence
  source: /note="Description of Artificial Sequence: Synthetic heavy chain variable region CDR H2"
IIYPGDSDARYSPSFQG

SEQ ID NO: 1334 - DNA, 51 bp, Artificial Sequence; identical to SEQ ID NO: 454
  source: /note="Description of Artificial Sequence: Synthetic heavy chain variable region CDR H2"

SEQ ID NO: 1335 - protein, 16 aa, Artificial Sequence
  source: /note="Description of Artificial Sequence: Synthetic heavy chain variable region CDR H3"
ARQDDSGWADFFPFDY

SEQ ID NO: 1336 - DNA, 48 bp, Artificial Sequence
  source: /note="Description of Artificial Sequence: Synthetic heavy chain variable region CDR H3"
gcgagacaagatgacagtggctgggccgacttctttccctttgactac

SEQ ID NO: 1337 - DNA, 324 bp, Artificial Sequence
  source: /note="Description of Artificial Sequence: Synthetic light chain variable region"
gaaattgtgttgacgcagtctccaggcaccctgtctttgtctccaggggaaagagccaccctctcctgcagggccagtcacagttttagcagcacctacttagcctggtaccagcagaaacctggccaggctcccaggctcctcatctatgctgcatccaacagggccactggcatcccagacaggttcagtggcagtgggtctgggacagacttcactctcaccatcagcagactggagcctgaagattttgcagtgtatttctgtcagcagtatgatagctcaccgtggacgttcggccaagggaccaagctggagatcaaa

SEQ ID NO: 1338 - protein, 108 aa, Artificial Sequence
  source: /note="Description of Artificial Sequence: Synthetic light chain variable region"
EIVLTQSPGTLSLSPGERATLSCRASHSFSSTYLAWYQQKPGQAPRLLIYAASNRATGIPDRFSGSGSGTDFTLTISRLEPEDFAVYFCQQYDSSPWTFGQGTKLEIK

SEQ ID NO: 1339 - protein, 12 aa, Artificial Sequence
  source: /note="Description of Artificial Sequence: Synthetic light chain variable region CDR L1"
RASHSFSSTYLA

SEQ ID NO: 1340 - DNA, 36 bp, Artificial Sequence
  source: /note="Description of Artificial Sequence: Synthetic light chain variable region CDR L1"
agggccagtcacagttttagcagcacctacttagcc

SEQ ID NO: 1341 - protein, 7 aa, Artificial Sequence
  source: /note="Description of Artificial Sequence: Synthetic light chain variable region CDR L2"
AASNRAT

SEQ ID NO: 1342 - DNA, 21 bp, Artificial Sequence
  source: /note="Description of Artificial Sequence: Synthetic light chain variable region CDR L2"
gctgcatccaacagggccact

SEQ ID NO: 1343 - protein, 9 aa, Artificial Sequence
  source: /note="Description of Artificial Sequence: Synthetic light chain variable region CDR L3"
QQYDSSPWT

SEQ ID NO: 1344 - DNA, 27 bp, Artificial Sequence
  source: /note="Description of Artificial Sequence: Synthetic light chain variable region CDR L3"
cagcagtatgatagctcaccgtggacg

SEQ ID NO: 1345 - DNA, 369 bp, Artificial Sequence
  source: /note="Description of Artificial Sequence: Synthetic heavy chain variable region"
caggtccagctggtacagtctggggctgaggtgaagaagcctgggtcctcggtgaaggtctcctgcaggacttctggaggcaccttcagcagcttttctatcagctgggtgcgacaggcccctggacaaggacttgaatggatgggagggatcatccctatctttgggacagcaaactacgcaaagaaattccagggcagagtcacaattaccgcggacgaatccacggacacagcctatatggaactgaggagcctgagatctgaggacacggccgtctattactgtgcgagagattcccccaaaatatcagcaactgaatattactttgactactggggccagggaaccctggtcaccgtctcctca

SEQ ID NO: 1346 - protein, 123 aa, Artificial Sequence
  source: /note="Description of Artificial Sequence: Synthetic heavy chain variable region"
QVQLVQSGAEVKKPGSSVKVSCRTSGGTFSSFSISWVRQAPGQGLEWMGGIIPIFGTANYAKKFQGRVTITADESTDTAYMELRSLRSEDTAVYYCARDSPKISATEYYFDYWGQGTLVTVSS

SEQ ID NO: 1347 - protein, 9 aa, Artificial Sequence
  source: /note="Description of Artificial Sequence: Synthetic heavy chain variable region CDR H1"
GTFSSFSIS

SEQ ID NO: 1348 - DNA, 27 bp, Artificial Sequence
  source: /note="Description of Artificial Sequence: Synthetic heavy chain variable region CDR H1"
ggcaccttcagcagcttttctatcagc

SEQ ID NO: 1349 - protein, 17 aa, Artificial Sequence
  source: /note="Description of Artificial Sequence: Synthetic heavy chain variable region CDR H2"
GIIPIFGTANYAKKFQG

SEQ ID NO: 1350 - DNA, 51 bp, Artificial Sequence
  source: /note="Description of Artificial Sequence: Synthetic heavy chain variable region CDR H2"
gggatcatccctatctttgggacagcaaactacgcaaagaaattccagggc

SEQ ID NO: 1351 - protein, 16 aa, Artificial Sequence
  source: /note="Description of Artificial Sequence: Synthetic heavy chain variable region CDR H3"
ARDSPKISATEYYFDY

SEQ ID NO: 1352 - DNA, 48 bp, Artificial Sequence
  source: /note="Description of Artificial Sequence: Synthetic heavy chain variable region CDR H3"
gcgagagattcccccaaaatatcagcaactgaatattactttgactac

SEQ ID NO: 1353 - DNA, 321 bp, Artificial Sequence
  source: /note="Description of Artificial Sequence: Synthetic light chain variable region"
gacatccaggtgacccagtctccttccaccctgtctgcatctgtaggagacagagtcaccatcacttgccgggccagtcagagttttactagttggttggcctggtatcagcagaaaccagggaaagcccctaagctcctgatctataaggcgtctactttagacagtggggtcccatcaaggttcagcggcagtggatctgggacagaattcactctcaccatcaacggcctgcagcctgatgattttgcaacttactactgccaacactatgatagttattcggggaccttcggccaagggacacgactggagattaaa

SEQ ID NO: 1354 - protein, 107 aa, Artificial Sequence
  source: /note="Description of Artificial Sequence: Synthetic light chain variable region"
DIQVTQSPSTLSASVGDRVTITCRASQSFTSWLAWYQQKPGKAPKLLIYKASTLDSGVPSRFSGSGSGTEFTLTINGLQPDDFATYYCQHYDSYSGTFGQGTRLEIK

SEQ ID NO: 1355 - protein, 11 aa, Artificial Sequence
  source: /note="Description of Artificial Sequence: Synthetic light chain variable region CDR L1"
RASQSFTSWLA

SEQ ID NO: 1356 - DNA, 33 bp, Artificial Sequence
  source: /note="Description of Artificial Sequence: Synthetic light chain variable region CDR L1"
cgggccagtcagagttttactagttggttggcc

SEQ ID NO: 1357 - protein, 7 aa, Artificial Sequence
  source: /note="Description of Artificial Sequence: Synthetic light chain variable region CDR L2"
KASTLDS

SEQ ID NO: 1358 - DNA, 21 bp, Artificial Sequence
  source: /note="Description of Artificial Sequence: Synthetic light chain variable region CDR L2"
aaggcgtctactttagacagt

SEQ ID NO: 1359 - protein, 9 aa, Artificial Sequence
  source: /note="Description of Artificial Sequence: Synthetic light chain variable region CDR L3"
QHYDSYSGT

SEQ ID NO: 1360 - DNA, 27 bp, Artificial Sequence
  source: /note="Description of Artificial Sequence: Synthetic light chain variable region CDR L3"
caacactatgatagttattcggggacc

SEQ ID NO: 1361 - DNA, 354 bp, Artificial Sequence
  source: /note="Description of Artificial Sequence: Synthetic heavy chain variable region"
gaggtgcagctgttggagtctgggggaggcttggtacagcctggggggtccctgagactctcctgtgcagcctctggattcacctttagcagctacgccatgagctgggtccgccagattccagggaaggggctggagtgggtctcaacaatcaatattagtggtggtagtacatactacgcagactccgtgaagggccggttcaccatctccagagacaattccagggacacggtgtttctacaaatgaatggcctgagagccgaggacacggccctatattactgcgcgaggggatatcatatagactggtttgacttttggggccagggaaccctggtcaccgtctcctca

SEQ ID NO: 1362 - protein, 118 aa, Artificial Sequence
  source: /note="Description of Artificial Sequence: Synthetic heavy chain variable region"
EVQLLESGGGLVQPGGSLRLSCAASGFTFSSYAMSWVRQIPGKGLEWVSTINISGGSTYYADSVKGRFTISRDNSRDTVFLQMNGLRAEDTALYYCARGYHIDWFDFWGQGTLVTVSS

SEQ ID NO: 1363 - protein, 9 aa, Artificial Sequence
  source: /note="Description of Artificial Sequence: Synthetic heavy chain variable region CDR H1"
FTFSSYAMS

SEQ ID NO: 1364 - DNA, 27 bp, Artificial Sequence
  source: /note="Description of Artificial Sequence: Synthetic heavy chain variable region CDR H1"
ttcacctttagcagctacgccatgagc

SEQ ID NO: 1365 - protein, 17 aa, Artificial Sequence
  source: /note="Description of Artificial Sequence: Synthetic heavy chain variable region CDR H2"
TINISGGSTYYADSVKG

SEQ ID NO: 1366 - DNA, 51 bp, Artificial Sequence
  source: /note="Description of Artificial Sequence: Synthetic heavy chain variable region CDR H2"
acaatcaatattagtggtggtagtacatactacgcagactccgtgaagggc

SEQ ID NO: 1367 - protein, 11 aa, Artificial Sequence
  source: /note="Description of Artificial Sequence: Synthetic heavy chain variable region CDR H3"
ARGYHIDWFDF

SEQ ID NO: 1368 - DNA, 33 bp, Artificial Sequence
  source: /note="Description of Artificial Sequence: Synthetic heavy chain variable region CDR H3"
gcgaggggatatcatatagactggtttgacttt

SEQ ID NO: 1369 - DNA, 321 bp, Artificial Sequence
  source: /note="Description of Artificial Sequence: Synthetic light chain variable region"
gatattgtgctgactcagactccatcttccgtgtctgcatctgtaggagacagagtcaccatcacttgtcgggcgagtcaggatattggcagctggttagcctggtatcagcagaaaccagggaaagcccctcaattcctgatctatgctgcatcccaattgcaaagtggggtcccatcaaggttcagcggcagtggatctgggacagatttcactcttaccatcagcagcctgcagcctgaagattttgcaacttactattgtcaacaggctaaaagtttacctcggactttcggcggagggaccaaagtggatatcaaa

SEQ ID NO: 1370 - protein, 107 aa, Artificial Sequence
  source: /note="Description of Artificial Sequence: Synthetic light chain variable region"
DIVLTQTPSSVSASVGDRVTITCRASQDIGSWLAWYQQKPGKAPQFLIYAASQLQSGVPSRFSGSGSGTDFTLTISSLQPEDFATYYCQQAKSLPRTFGGGTKVDIK

SEQ ID NO: 1371 - protein, 11 aa, Artificial Sequence
  source: /note="Description of Artificial Sequence: Synthetic light chain variable region CDR L1"
RASQDIGSWLA

SEQ ID NO: 1372 - DNA, 33 bp, Artificial Sequence
  source: /note="Description of Artificial Sequence: Synthetic light chain variable region CDR L1"
cgggcgagtcaggatattggcagctggttagcc

SEQ ID NO: 1373 - protein, 7 aa, Artificial Sequence
  source: /note="Description of Artificial Sequence: Synthetic light chain variable region CDR L2"
AASQLQS

SEQ ID NO: 1374 - DNA, 21 bp, Artificial Sequence
  source: /note="Description of Artificial Sequence: Synthetic light chain variable region CDR L2"
gctgcatcccaattgcaaagt

SEQ ID NO: 1375 - protein, 9 aa, Artificial Sequence
  source: /note="Description of Artificial Sequence: Synthetic light chain variable region CDR L3"
QQAKSLPRT

SEQ ID NO: 1376 - DNA, 27 bp, Artificial Sequence
  source: /note="Description of Artificial Sequence: Synthetic light chain variable region CDR L3"
caacaggctaaaagtttacctcggact

SEQ ID NO: 1377 - DNA, 390 bp, Artificial Sequence
  source: /note="Description of Artificial Sequence: Synthetic heavy chain variable region"
gaggtgcagctgttggagtctggaggaggcttgatccagcctggggggtccctgagactctcctgtggagcctctgggttcaccgtcactggcaactacatgcattgggtccgccaggctccagggaaggggctggagtgggtctcagttatttatgccggttctagcacatattacgcagactccgtgaggggccgattcaccatctccagagacaaggccaggaacacgttgtttcttcaaatgaatagactgagagccgaggacacggccgtgtattattgtgcgagagcgggggtagttggggaagatagaagtggctggtacggtcccgattatttccacggtttggacgtctggggccaagggaccacggtcaccgtctcctca

SEQ ID NO: 1378 - protein, 130 aa, Artificial Sequence
  source: /note="Description of Artificial Sequence: Synthetic heavy chain variable region"
EVQLLESGGGLIQPGGSLRLSCGASGFTVTGNYMHWVRQAPGKGLEWVSVIYAGSSTYYADSVRGRFTISRDKARNTLFLQMNRLRAEDTAVYYCARAGVVGEDRSGWYGPDYFHGLDVWGQGTTVTVSS

SEQ ID NO: 1379 - protein, 9 aa, Artificial Sequence
  source: /note="Description of Artificial Sequence: Synthetic heavy chain variable region CDR H1"
FTVTGNYMH

SEQ ID NO: 1380 - DNA, 27 bp, Artificial Sequence
  source: /note="Description of Artificial Sequence: Synthetic heavy chain variable region CDR H1"
ttcaccgtcactggcaactacatgcat

SEQ ID NO: 1381 - protein, 16 aa, Artificial Sequence
  source: /note="Description of Artificial Sequence: Synthetic heavy chain variable region CDR H2"
VIYAGSSTYYADSVRG

SEQ ID NO: 1382 - DNA, 48 bp, Artificial Sequence
  source: /note="Description of Artificial Sequence: Synthetic heavy chain variable region CDR H2"
gttatttatgccggttctagcacatattacgcagactccgtgaggggc

SEQ ID NO: 1383 - protein, 24 aa, Artificial Sequence
  source: /note="Description of Artificial Sequence: Synthetic heavy chain variable region CDR H3"
ARAGVVGEDRSGWYGPDYFHGLDV

SEQ ID NO: 1384 - DNA, 72 bp, Artificial Sequence
  source: /note="Description of Artificial Sequence: Synthetic heavy chain variable region CDR H3"
gcgagagcgggggtagttggggaagatagaagtggctggtacggtcccgattatttccacggtttggacgtc

SEQ ID NO: 1385 - DNA, 324 bp, Artificial Sequence
  source: /note="Description of Artificial Sequence: Synthetic light chain variable region"
gaaacgacactcacgcagtctccaggcaccctgtctttgtctccaggggaaagagccaccctctcctgcagggccagtcagagtattcgcaacaactacttagcctggtaccagcaaaaacctggccagcctcccaggctcctcatctatggtgaatccagaagggccactggcatcccaggcaggttcagtggcagtgggtctgggacagacttcactctcaccatcagcagcctggagcctgaagattttgcagtgtattactgtcagcagtatggtggctcaccgtacacttttggccaggggaccaaggtggatatcaaa

SEQ ID NO: 1386 - protein, 108 aa, Artificial Sequence
  source: /note="Description of Artificial Sequence: Synthetic light chain variable region"
ETTLTQSPGTLSLSPGERATLSCRASQSIRNNYLAWYQQKPGQPPRLLIYGESRRATGIPGRFSGSGSGTDFTLTISSLEPEDFAVYYCQQYGGSPYTFGQGTKVDIK

SEQ ID NO: 1387 - protein, 12 aa, Artificial Sequence
  source: /note="Description of Artificial Sequence: Synthetic light chain variable region CDR L1"
RASQSIRNNYLA

SEQ ID NO: 1388 - DNA, 36 bp, Artificial Sequence
  source: /note="Description of Artificial Sequence: Synthetic light chain variable region CDR L1"
agggccagtcagagtattcgcaacaactacttagcc

SEQ ID NO: 1389 - protein, 7 aa, Artificial Sequence
  source: /note="Description of Artificial Sequence: Synthetic light chain variable region CDR L2"
GESRRAT

SEQ ID NO: 1390 - DNA, 21 bp, Artificial Sequence
  source: /note="Description of Artificial Sequence: Synthetic light chain variable region CDR L2"
ggtgaatccagaagggccact

SEQ ID NO: 1391 - protein, 9 aa, Artificial Sequence
  source: /note="Description of Artificial Sequence: Synthetic light chain variable region CDR L3"
QQYGGSPYT

SEQ ID NO: 1392 - DNA, 27 bp, Artificial Sequence
  source: /note="Description of Artificial Sequence: Synthetic light chain variable region CDR L3"
cagcagtatggtggctcaccgtacact

SEQ ID NO: 1393 - DNA, 378 bp, Artificial Sequence
  source: /note="Description of Artificial Sequence: Synthetic heavy chain variable region"
caggtccagcttgtgcagtctggggctgaggtgaagaagcctgggtcctcggtgagggtctcctgcgaggcttctggaggcaccttcagcacctatgctattagctgggtgcgacaggcccctggactagggcttgagtggatgggagggatccaccccatctctggtacagcaaactacgcacagagcttccaggacagactcaccattaccgtggacaagtccacgagcacagcctacatggacctgagcagcctgagatctgaggacacggccatatattattgtgcgagagttggtctgggtcgcacttggatttatgatacaatgggttaccttgactactggggccagggaaccctggtcaccgtctcctca

SEQ ID NO: 1394 - protein, 126 aa, Artificial Sequence
  source: /note="Description of Artificial Sequence: Synthetic heavy chain variable region"
QVQLVQSGAEVKKPGSSVRVSCEASGGTFSTYAISWVRQAPGLGLEWMGGIHPISGTANYAQSFQDRLTITVDKSTSTAYMDLSSLRSEDTAIYYCARVGLGRTWIYDTMGYLDYWGQGTLVTVSS

SEQ ID NO: 1395 - protein, 9 aa, Artificial Sequence
  source: /note="Description of Artificial Sequence: Synthetic heavy chain variable region CDR H1"
GTFSTYAIS

SEQ ID NO: 1396 - DNA, 27 bp, Artificial Sequence
  source: /note="Description of Artificial Sequence: Synthetic heavy chain variable region CDR H1"
ggcaccttcagcacctatgctattagc

SEQ ID NO: 1397 - protein, 17 aa, Artificial Sequence
  source: /note="Description of Artificial Sequence: Synthetic heavy chain variable region CDR H2"
GIHPISGTANYAQSFQD

SEQ ID NO: 1398 - DNA, 51 bp, Artificial Sequence
  source: /note="Description of Artificial Sequence: Synthetic heavy chain variable region CDR H2"
gggatccaccccatctctggtacagcaaactacgcacagagcttccaggac

SEQ ID NO: 1399 - protein, 19 aa, Artificial Sequence
  source: /note="Description of Artificial Sequence: Synthetic heavy chain variable region CDR H3"
ARVGLGRTWIYDTMGYLDY

SEQ ID NO: 1400 - DNA, 57 bp, Artificial Sequence
  source: /note="Description of Artificial Sequence: Synthetic heavy chain variable region CDR H3"
gcgagagttggtctgggtcgcacttggatttatgatacaatgggttaccttgactac

SEQ ID NO: 1401 - DNA, 324 bp, Artificial Sequence
  source: /note="Description of Artificial Sequence: Synthetic light chain variable region"
gaaattgtattgacacagtctccagccaccctgtctttgtctccaggggagagagtcaccctctcctgcagggccagtcagagtgttaacgactacttagcctggtaccaacaaaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtaccaactggccttccctcactttcggcggagggaccaaggtggaaatcaaa

SEQ ID NO: 1402 - protein, 108 aa, Artificial Sequence
  source: /note="Description of Artificial Sequence: Synthetic light chain variable region"
EIVLTQSPATLSLSPGERVTLSCRASQSVNDYLAWYQQKPGQAPRLLIYDASNRATGIPARFSGSGSGTDFTLTISSLEPEDFAVYYCQHRTNWPSLTFGGGTKVEIK

SEQ ID NO: 1403 - protein, 11 aa, Artificial Sequence
  source: /note="Description of Artificial Sequence: Synthetic light chain variable region CDR L1"
RASQSVNDYLA

SEQ ID NO: 1404 - DNA, 33 bp, Artificial Sequence
  source: /note="Description of Artificial Sequence: Synthetic light chain variable region CDR L1"
agggccagtcagagtgttaacgactacttagcc

SEQ ID NO: 1405 - protein, 7 aa, Artificial Sequence
  source: /note="Description of Artificial Sequence: Synthetic light chain variable region CDR L2"
DASNRAT

SEQ ID NO: 1406 - DNA, 21 bp, Artificial Sequence
  source: /note="Description of Artificial Sequence: Synthetic light chain variable region CDR L2"
gatgcatccaacagggccact

SEQ ID NO: 1407 - protein, 10 aa, Artificial Sequence
  source: /note="Description of Artificial Sequence: Synthetic light chain variable region CDR L3"
QHRTNWPSLT

SEQ ID NO: 1408 - DNA, 30 bp, Artificial Sequence
  source: /note="Description of Artificial Sequence: Synthetic light chain variable region CDR L3"
cagcaccgtaccaactggccttccctcact

SEQ ID NO: 1409 - DNA, 357 bp, Artificial Sequence
  source: /note="Description of Artificial Sequence: Synthetic heavy chain variable region"
gaggtgcagctggtggagtctgggggaggcctggtcaagcctggggggtccctgagactctcctgtgcagcctcgggattcaccatcagtggttataacatgttctgggtccgccagcctccggggaaggggctggagtgggtctcatccattactgctggtagtagttatttaaactatgcagactcagtgaagggccgtttcatcgtctccagagacaacgccaagaattcactgtatctgcaaatgaacagcctgagagccgaggacacggctgtttatttctgtgcgagagcacctcttttacccgctatgatggacctctggggccaagggaccacggtcaccgtctcctca

SEQ ID NO: 1410 - protein, 119 aa, Artificial Sequence
  source: /note="Description of Artificial Sequence: Synthetic heavy chain variable region"
EVQLVESGGGLVKPGGSLRLSCAASGFTISGYNMFWVRQPPGKGLEWVSSITAGSSYLNYADSVKGRFIVSRDNAKNSLYLQMNSLRAEDTAVYFCARAPLLPAMMDLWGQGTTVTVSS

SEQ ID NO: 1411 - protein, 9 aa, Artificial Sequence
  source: /note="Description of Artificial Sequence: Synthetic heavy chain variable region CDR H1"
FTISGYNMF

SEQ ID NO: 1412 - DNA, 27 bp, Artificial Sequence
  source: /note="Description of Artificial Sequence: Synthetic heavy chain variable region CDR H1"
ttcaccatcagtggttataacatgttc

SEQ ID NO: 1413 - protein, 17 aa, Artificial Sequence
  source: /note="Description of Artificial Sequence: Synthetic heavy chain variable region CDR H2"
SITAGSSYLNYADSVKG

SEQ ID NO: 1414 - DNA, 51 bp, Artificial Sequence; identical to SEQ ID NO: 326
  source: /note="Description of Artificial Sequence: Synthetic heavy chain variable region CDR H2"

SEQ ID NO: 1415 - protein, 12 aa, Artificial Sequence
  source: /note="Description of Artificial Sequence: Synthetic heavy chain variable region CDR H3"
ARAPLLPAMMDL

SEQ ID NO: 1416 - DNA, 36 bp, Artificial Sequence; identical to SEQ ID NO: 328
  source: /note="Description of Artificial Sequence: Synthetic heavy chain variable region CDR H3"

SEQ ID NO: 1417 - DNA, 333 bp, Artificial Sequence
  source: /note="Description of Artificial Sequence: Synthetic light chain variable region"
cagtctgtggtgacgcagccgccctcagtgtctggggccccagggcagagggtcaccatctcctgcactgggagcagctccaacatcggggcaggttatgatgtacactggtaccagcaacttccaggaacagcccccaaactcctcatctatactaacaacaatcggccctcaggggtccctgaccgattctctggctccaagtctggcacctcagcctccctggccatcactgggctccaggctgaggatgaggctgactattactgccagtcctatgacagaagcctgaatggttatgtcttcggaactgggaccacggtcaccgtccta

SEQ ID NO: 1418 - protein, 111 aa, Artificial Sequence
  source: /note="Description of Artificial Sequence: Synthetic light chain variable region"
QSVVTQPPSVSGAPGQRVTISCTGSSSNIGAGYDVHWYQQLPGTAPKLLIYTNNNRPSGVPDRFSGSKSGTSASLAITGLQAEDEADYYCQSYDRSLNGYVFGTGTTVTVL

SEQ ID NO: 1419 - protein, 14 aa, Artificial Sequence
  source: /note="Description of Artificial Sequence: Synthetic light chain variable region CDR L1"
TGSSSNIGAGYDVH

SEQ ID NO: 1420 - DNA, 42 bp, Artificial Sequence; identical to SEQ ID NO: 60
  source: /note="Description of Artificial Sequence: Synthetic light chain variable region CDR L1"

SEQ ID NO: 1421 - protein, 7 aa, Artificial Sequence
  source: /note="Description of Artificial Sequence: Synthetic light chain variable region CDR L2"
TNNNRPS

SEQ ID NO: 1422 - DNA, 21 bp, Artificial Sequence
  source: /note="Description of Artificial Sequence: Synthetic light chain variable region CDR L2"
actaacaacaatcggccctca

SEQ ID NO: 1423 - protein, 11 aa, Artificial Sequence
  source: /note="Description of Artificial Sequence: Synthetic light chain variable region CDR L3"
QSYDRSLNGYV

SEQ ID NO: 1424 - DNA, 33 bp, Artificial Sequence; identical to SEQ ID NO: 336
  source: /note="Description of Artificial Sequence: Synthetic light chain variable region CDR L3"

SEQ ID NO: 1425 - DNA, 372 bp, Artificial Sequence
  source: /note="Description of Artificial Sequence: Synthetic heavy chain variable region"
gaggtgcagctggtggagtctgggggaggcctggtcaagcctggggggtccctgagactctcctgtgcagcccctggattcaccatcaggagttataccatgtactgggtccgccaggctccagggaaggggctggagtgggtcgcatccattagtagtagtagtagttacatacactatggagactcagtgaagggccgattcaccatcgccagagacaatgccaagaactcactgtatctgcaaatgaacagcctgagagccgaggacacggctgtgtattactgtgtgagagatcattgtactggtggaagctgctacttaaacggtatggacgtctggggccaagggaccacggtcaccgtctcctca

SEQ ID NO: 1426 - protein, 124 aa, Artificial Sequence
  source: /note="Description of Artificial Sequence: Synthetic heavy chain variable region"
EVQLVESGGGLVKPGGSLRLSCAAPGFTIRSYTMYWVRQAPGKGLEWVASISSSSSYIHYGDSVKGRFTIARDNAKNSLYLQMNSLRAEDTAVYYCVRDHCTGGSCYLNGMDVWGQGTTVTVSS

SEQ ID NO: 1427 - protein, 9 aa, Artificial Sequence
  source: /note="Description of Artificial Sequence: Synthetic heavy chain variable region CDR H1"
FTIRSYTMY

SEQ ID NO: 1428 - DNA, 27 bp, Artificial Sequence
  source: /note="Description of Artificial Sequence: Synthetic heavy chain variable region CDR H1"
ttcaccatcaggagttataccatgtac

SEQ ID NO: 1429 - protein, 17 aa, Artificial Sequence
  source: /note="Description of Artificial Sequence: Synthetic heavy chain variable region CDR H2"
SISSSSSYIHYGDSVKG

SEQ ID NO: 1430 - DNA, 51 bp, Artificial Sequence
  source: /note="Description of Artificial Sequence: Synthetic heavy chain variable region CDR H2"
tccattagtagtagtagtagttacatacactatggagactcagtgaagggc

SEQ ID NO: 1431 - protein, 17 aa, Artificial Sequence
  source: /note="Description of Artificial Sequence: Synthetic heavy chain variable region CDR H3"
VRDHCTGGSCYLNGMDV

SEQ ID NO: 1432 - DNA, 51 bp, Artificial Sequence
  source: /note="Description of Artificial Sequence: Synthetic heavy chain variable region CDR H3"
gtgagagatcattgtactggtggaagctgctacttaaacggtatggacgtc

SEQ ID NO: 1433 - DNA, 333 bp, Artificial Sequence
  source: /note="Description of Artificial Sequence: Synthetic light chain variable region"
cagcctgtgctgactcagccaccctcagtgtctggggccccagggcagagggtcaccatctcctgcactgggaccagctccaacatcggggcaggttatgatgtacactggtaccagcagcttccaggaacagcccccaaactcctcatctatggtaacaacaatcggccctcaggggtccctgaccgattctctggctccaagtctggcacctcagcctccctggccatcactgggctccaggctgaggatgaggctgattattactgccagtcctatgacagcagcctgagcggttcggtattcggcggagggaccaagctcaccgtccta

SEQ ID NO: 1434 - protein, 111 aa, Artificial Sequence
  source: /note="Description of Artificial Sequence: Synthetic light chain variable region"
QPVLTQPPSVSGAPGQRVTISCTGTSSNIGAGYDVHWYQQLPGTAPKLLIYGNNNRPSGVPDRFSGSKSGTSASLAITGLQAEDEADYYCQSYDSSLSGSVFGGGTKLTVL

SEQ ID NO: 1435 - protein, 14 aa, Artificial Sequence
  source: /note="Description of Artificial Sequence: Synthetic light chain variable region CDR L1"
TGTSSNIGAGYDVH

SEQ ID NO: 1436 - DNA, 42 bp, Artificial Sequence
  source: /note="Description of Artificial Sequence: Synthetic light chain variable region CDR L1"
actgggaccagctccaacatcggggcaggttatgatgtacac

SEQ ID NO: 1437 - protein, 7 aa, Artificial Sequence
  source: /note="Description of Artificial Sequence: Synthetic light chain variable region CDR L2"
GNNNRPS

SEQ ID NO: 1438 - DNA, 21 bp, Artificial Sequence
  source: /note="Description of Artificial Sequence: Synthetic light chain variable region CDR L2"
ggtaacaacaatcggccctca

SEQ ID NO: 1439 - protein, 11 aa, Artificial Sequence
  source: /note="Description of Artificial Sequence: Synthetic light chain variable region CDR L3"
QSYDSSLSGSV

SEQ ID NO: 1440 - DNA, 33 bp, Artificial Sequence
  source: /note="Description of Artificial Sequence: Synthetic light chain variable region CDR L3"
cagtcctatgacagcagcctgagcggttcggta

SEQ ID NO: 1441 - DNA, 372 bp, Artificial Sequence
  source: /note="Description of Artificial Sequence: Synthetic heavy chain variable region"
gaggtgcagctggtggagtctggaggaggcttgatccagcctggggggtccctgagactctcctgtgcagcctctgggttcaccgtcagtagcaagtacatgagctgggtccgccaggctccagggaaggggctggagtgggtctcaattatttatagtggtggtagcacatactacgcagactccgtgaagggccgattcaccatctccagagacaattccaagaacacactgtatcttcaaatgaacagcctgagagccgaggacacggccgtgtattactgtgcgagagatgattacgatttttggagtggcaacggcccaccggagatggccgtctggggccaggggaccacggtcaccgtctcctca

SEQ ID NO: 1442 - protein, 124 aa, Artificial Sequence
  source: /note="Description of Artificial Sequence: Synthetic heavy chain variable region"
EVQLVESGGGLIQPGGSLRLSCAASGFTVSSKYMSWVRQAPGKGLEWVSIIYSGGSTYYADSVKGRFTISRDNSKNTLYLQMNSLRAEDTAVYYCARDDYDFWSGNGPPEMAVWGQGTTVTVSS

SEQ ID NO: 1443 - protein, 9 aa, Artificial Sequence
  source: /note="Description of Artificial Sequence: Synthetic heavy chain variable region CDR H1"
FTVSSKYMS

SEQ ID NO: 1444 - DNA, 27 bp, Artificial Sequence
  source: /note="Description of Artificial Sequence: Synthetic heavy chain variable region CDR H1"
ttcaccgtcagtagcaagtacatgagc

SEQ ID NO: 1445 - protein, 16 aa, Artificial Sequence
  source: /note="Description of Artificial Sequence: Synthetic heavy chain variable region CDR H2"
IIYSGGSTYYADSVKG

SEQ ID NO: 1446 - DNA, 48 bp, Artificial Sequence
  source: /note="Description of Artificial Sequence: Synthetic heavy chain variable region CDR H2"
attatttatagtggtggtagcacatactacgcagactccgtgaagggc

SEQ ID NO: 1447 - protein, 18 aa, Artificial Sequence
  source: /note="Description of Artificial Sequence: Synthetic heavy chain variable region CDR H3"
ARDDYDFWSGNGPPEMAV

SEQ ID NO: 1448 - DNA, 54 bp, Artificial Sequence; identical to SEQ ID NO: 1320
  source: /note="Description of Artificial Sequence: Synthetic heavy chain variable region CDR H3"

SEQ ID NO: 1449 - DNA, 321 bp, Artificial Sequence
  source: /note="Description of Artificial Sequence: Synthetic light chain variable region"
gacatgagactcacccagtctccatcctccctgtctgcgtctgtaggagacagagtcaccatcacttgccgggcgagtcagggcattagcaattatttagcctggtatcagcagagaccagggaaagttcctcagctcctgatctatactgcatccactttgcaatcaggggtcccatctcggttcagtggcagtggatctgagacagatttcactctcaccatcagcagcctgcagcctgaagatgttgcaacttattactgtcaaaagtatgacagtgtccctctgacgttcggccaagggaccaaggtggaaatcaaa

SEQ ID NO: 1450 - protein, 107 aa, Artificial Sequence
  source: /note="Description of Artificial Sequence: Synthetic light chain variable region"
DMRLTQSPSSLSASVGDRVTITCRASQGISNYLAWYQQRPGKVPQLLIYTASTLQSGVPSRFSGSGSETDFTLTISSLQPEDVATYYCQKYDSVPLTFGQGTKVEIK

SEQ ID NO: 1451 - protein, 11 aa, Artificial Sequence
  source: /note="Description of Artificial Sequence: Synthetic light chain variable region CDR L1"
RASQGISNYLA

SEQ ID NO: 1452 - DNA, 33 bp, Artificial Sequence; identical to SEQ ID NO: 1324
  source: /note="Description of Artificial Sequence: Synthetic light chain variable region CDR L1"

SEQ ID NO: 1453 - protein, 7 aa, Artificial Sequence
  source: /note="Description of Artificial Sequence: Synthetic light chain variable region CDR L2"
TASTLQS

SEQ ID NO: 1454 - DNA, 21 bp, Artificial Sequence
  source: /note="Description of Artificial Sequence: Synthetic light chain variable region CDR L2"
actgcatccactttgcaatca

SEQ ID NO: 1455 - protein, 9 aa, Artificial Sequence
  source: /note="Description of Artificial Sequence: Synthetic light chain variable region CDR L3"
QKYDSVPLT

SEQ ID NO: 1456 - DNA, 27 bp, Artificial Sequence
  source: /note="Description of Artificial Sequence: Synthetic light chain variable region CDR L3"
caaaagtatgacagtgtccctctgacg

SEQ ID NO: 1457 - DNA, 369 bp, Artificial Sequence
  source: /note="Description of Artificial Sequence: Synthetic heavy chain variable region"
gaggtgcagctggtggagtctggtcctgcgctggtgaaacccacacagaccctcacactgacctgcaccgtctcggggggtgttgagagaatgagtgtgagttgggtccgtcagcccccagggaaggccctggagtggcttgcacgcattgattgggatgatgataaatactacaacacatttctgaagaccaggctcaccatctccaagggcacctccaaaaacgaggtggtccttacaatgaccaacatggaccctgaagacacagcaatttattactgtgcacggacgaatcgctatgataaaagtggttattacctttattaccttgactactggggccagggaaccctggtcactgtctcctca

SEQ ID NO: 1458 - protein, 123 aa, Artificial Sequence
  source: /note="Description of Artificial Sequence: Synthetic heavy chain variable region"
EVQLVESGPALVKPTQTLTLTCTVSGGVERMSVSWVRQPPGKALEWLARIDWDDDKYYNTFLKTRLTISKGTSKNEVVLTMTNMDPEDTAIYYCARTNRYDKSGYYLYYLDYWGQGTLVTVSS

SEQ ID NO: 1459 - protein, 8 aa, Artificial Sequence
  source: /note="Description of Artificial Sequence: Synthetic heavy chain variable region CDR H1"
GVERMSVS

SEQ ID NO: 1460 - DNA, 24 bp, Artificial Sequence
  source: /note="Description of Artificial Sequence: Synthetic heavy chain variable region CDR H1"
ggtgttgagagaatgagtgtgagt

SEQ ID NO: 1461 - protein, 16 aa, Artificial Sequence
  source: /note="Description of Artificial Sequence: Synthetic heavy chain variable region CDR H2"
RIDWDDDKYYNTFLKT

SEQ ID NO: 1462 - DNA, 48 bp, Artificial Sequence
  source: /note="Description of Artificial Sequence: Synthetic heavy chain variable region CDR H2"
cgcattgattgggatgatgataaatactacaacacatttctgaagacc

SEQ ID NO: 1463 - protein, 18 aa, Artificial Sequence
  source: /note="Description of Artificial Sequence: Synthetic heavy chain variable region CDR H3"
ARTNRYDKSGYYLYYLDY

SEQ ID NO: 1464 - DNA, 54 bp, Artificial Sequence
  source: /note="Description of Artificial Sequence: Synthetic heavy chain variable region CDR H3"
gcacggacgaatcgctatgataaaagtggttattacctttattaccttgactac

SEQ ID NO: 1465 - DNA, 321 bp, Artificial Sequence
  source: /note="Description of Artificial Sequence: Synthetic light chain variable region"
gacatccagatgacccagtctccatcctccctgtctgcatctgtaggagacaaagtcaccatcacttgccgggcaagtcagaccattgccagttatgtaaattggtatcagcagcacccagggaaagcccctaagctcctaatctatcttgcatcccgtttgcaaagtggtgccccatcaaggttcagtggcagtggatctgggacagatttcactctcaccatcctcaatctgcaacctgaagattttgcaacttactactgtcaacagagttacagttcgtttttcactttcggccctgggaccaaggtggaaatcaaa

SEQ ID NO: 1466 - protein, 107 aa, Artificial Sequence
  source: /note="Description of Artificial Sequence: Synthetic light chain variable region"
DIQMTQSPSSLSASVGDKVTITCRASQTIASYVNWYQQHPGKAPKLLIYLASRLQSGAPSRFSGSGSGTDFTLTILNLQPEDFATYYCQQSYSSFFTFGPGTKVEIK

SEQ ID NO: 1467 - protein, 11 aa, Artificial Sequence
  source: /note="Description of Artificial Sequence: Synthetic light chain variable region CDR L1"
RASQTIASYVN

SEQ ID NO: 1468 - DNA, 33 bp, Artificial Sequence
  source: /note="Description of Artificial Sequence: Synthetic light chain variable region CDR L1"
cgggcaagtcagaccattgccagttatgtaaat

SEQ ID NO: 1469 - protein, 7 aa, Artificial Sequence
  source: /note="Description of Artificial Sequence: Synthetic light chain variable region CDR L2"
LASRLQS

SEQ ID NO: 1470 - DNA, 21 bp, Artificial Sequence
  source: /note="Description of Artificial Sequence: Synthetic light chain variable region CDR L2"
cttgcatcccgtttgcaaagt

SEQ ID NO: 1471 - protein, 9 aa, Artificial Sequence
  source: /note="Description of Artificial Sequence: Synthetic light chain variable region CDR L3"
QQSYSSFFT

SEQ ID NO: 1472 - DNA, 27 bp, Artificial Sequence
  source: /note="Description of Artificial Sequence: Synthetic light chain variable region CDR L3"
caacagagttacagttcgtttttcact

SEQ ID NO: 1473 - DNA, 372 bp, Artificial Sequence
  source: /note="Description of Artificial Sequence: Synthetic heavy chain variable region"
gaggtgcagctgttggagtctgggggaggcgtggtccagcctgggaggtccctgagactctcctgtgcagcctctggattcaccttcagtgacttttctatgcactgggtccgccaggctccaggcaaggggctggagtgggtggcactcatctcaaatgatggaagcaataaatattattcagactccctgaagggttcattcatcatctccagagacaactccaagaacacgctctatctccaactgaacagcctgggagctgaggacacggctctctattactgtgcgagagatgcggttccccattatgattacgtctggggaaactttgactactggggccagggaaccctggtcactgtctcctca

SEQ ID NO: 1474 - protein, 124 aa, Artificial Sequence
  source: /note="Description of Artificial Sequence: Synthetic heavy chain variable region"
EVQLLESGGGVVQPGRSLRLSCAASGFTFSDFSMHWVRQAPGKGLEWVALISNDGSNKYYSDSLKGSFIISRDNSKNTLYLQLNSLGAEDTALYYCARDAVPHYDYVWGNFDYWGQGTLVTVSS

SEQ ID NO: 1475 - protein, 9 aa, Artificial Sequence
  source: /note="Description of Artificial Sequence: Synthetic heavy chain variable region CDR H1"
FTFSDFSMH

SEQ ID NO: 1476 - DNA, 27 bp, Artificial Sequence
  source: /note="Description of Artificial Sequence: Synthetic heavy chain variable region CDR H1"
ttcaccttcagtgacttttctatgcac

SEQ ID NO: 1477 - protein, 17 aa, Artificial Sequence
  source: /note="Description of Artificial Sequence: Synthetic heavy chain variable region CDR H2"
LISNDGSNKYYSDSLKG

SEQ ID NO: 1478 - DNA, 51 bp, Artificial Sequence; identical to SEQ ID NO: 1110
  source: /note="Description of Artificial Sequence: Synthetic heavy chain variable region CDR H2"

SEQ ID NO: 1479 - protein, 17 aa, Artificial Sequence
  source: /note="Description of Artificial Sequence: Synthetic heavy chain variable region CDR H3"
ARDAVPHYDYVWGNFDY

SEQ ID NO: 1480 - DNA, 51 bp, Artificial Sequence; identical to SEQ ID NO: 1112
  source: /note="Description of Artificial Sequence: Synthetic heavy chain variable region CDR H3"

SEQ ID NO: 1481 - DNA, 330 bp, Artificial Sequence
  source: /note="Description of Artificial Sequence: Synthetic light chain variable region"
cagtctgttctgactcagcctgcctccgtgtctgcgtctcctggacagtcgatcaccatctcctgcactggaaccagcagtgacgttggtggttataattatgtctcctggtaccaacagcacccaggcaaagcccccaaactcataatttatgaggtcagtaatcggccctcaggggtttctaatcgcttctctggctccaagtctggcaacacggcctccctgaccatctctgggctccaggctgacgacgaggctgattattactgcagctcatatacaagtttcactcccgtggtattcggcggagggaccaagctgaccgtccta

SEQ ID NO: 1482 - protein, 110 aa, Artificial Sequence
  source: /note="Description of Artificial Sequence: Synthetic light chain variable region"
QSVLTQPASVSASPGQSITISCTGTSSDVGGYNYVSWYQQHPGKAPKLIIYEVSNRPSGVSNRFSGSKSGNTASLTISGLQADDEADYYCSSYTSFTPVVFGGGTKLTVL

SEQ ID NO: 1483 - protein, 14 aa, Artificial Sequence
  source: /note="Description of Artificial Sequence: Synthetic light chain variable region CDR L1"
TGTSSDVGGYNYVS

SEQ ID NO: 1484 - DNA, 42 bp, Artificial Sequence; identical to SEQ ID NO: 1116
  source: /note="Description of Artificial Sequence: Synthetic light chain variable region CDR L1"

SEQ ID NO: 1485 - protein, 7 aa, Artificial Sequence
  source: /note="Description of Artificial Sequence: Synthetic light chain variable region CDR L2"
EVSNRPS

SEQ ID NO: 1486 - DNA, 21 bp, Artificial Sequence
  source: /note="Description of Artificial Sequence: Synthetic light chain variable region CDR L2"
gaggtcagtaatcggccctca

SEQ ID NO: 1487 - protein, 10 aa, Artificial Sequence
  source: /note="Description of Artificial Sequence: Synthetic light chain variable region CDR L3"
SSYTSFTPVV

SEQ ID NO: 1488 - DNA, 30 bp, Artificial Sequence; identical to SEQ ID NO: 1120
  source: /note="Description of Artificial Sequence: Synthetic light chain variable region CDR L3"

SEQ ID NO: 1489 - DNA, 360 bp, Artificial Sequence
  source: /note="Description of Artificial Sequence: Synthetic heavy chain variable region"
caggtccagcttgtacagtctggggcggaggtgaagaagcctgggtcctcggtgaaggtctcttgtaagtcttctggagggaccttcagcaactatattatcagctgggtgcgacaggcccctggacaagggcttgagtggatgggagggatcgtccctctctctggaacaacagactacgcacagaagttccagggccgagtcacgattaccgcggacaaatccacgactacagcctacatggagcttcgcaccttgagacctgaggacacggccgtctattattgtgcgagggggagtggtggtagcaatgcctacttcgacccctggggccagggaaccctggtcaccgtctcctca

SEQ ID NO: 1490 - protein, 120 aa, Artificial Sequence
  source: /note="Description of Artificial Sequence: Synthetic heavy chain variable region"
QVQLVQSGAEVKKPGSSVKVSCKSSGGTFSNYIISWVRQAPGQGLEWMGGIVPLSGTTDYAQKFQGRVTITADKSTTTAYMELRTLRPEDTAVYYCARGSGGSNAYFDPWGQGTLVTVSS

SEQ ID NO: 1491 - protein, 9 aa, Artificial Sequence
  source: /note="Description of Artificial Sequence: Synthetic heavy chain variable region CDR H1"
GTFSNYIIS

SEQ ID NO: 1492 - DNA, 27 bp, Artificial Sequence
  source: /note="Description of Artificial Sequence: Synthetic heavy chain variable region CDR H1"
gggaccttcagcaactatattatcagc

SEQ ID NO: 1493 - protein, 17 aa, Artificial Sequence
  source: /note="Description of Artificial Sequence: Synthetic heavy chain variable region CDR H2"
GIVPLSGTTDYAQKFQG

SEQ ID NO: 1494 - DNA, 51 bp, Artificial Sequence
  source: /note="Description of Artificial Sequence: Synthetic heavy chain variable region CDR H2"
gggatcgtccctctctctggaacaacagactacgcacagaagttccagggc

SEQ ID NO: 1495 - protein, 13 aa, Artificial Sequence
  source: /note="Description of Artificial Sequence: Synthetic heavy chain variable region CDR H3"
ARGSGGSNAYFDP

SEQ ID NO: 1496 - DNA, 39 bp, Artificial Sequence
  source: /note="Description of Artificial Sequence: Synthetic heavy chain variable region CDR H3"
gcgagggggagtggtggtagcaatgcctacttcgacccc

SEQ ID NO: 1497 - DNA, 327 bp, Artificial Sequence
  source: /note="Description of Artificial Sequence: Synthetic light chain variable region"
cagtctgtggtgacgcagccgccctcagtgtcagtggccccaggaaagacggccaagattacctgtgggggaaacaacattggaagtaagagtgtgtactggtaccaacagaagccaggccaggcccctgtgctggtcatgtattatgatacttaccggccctcagggatccctgagcgcttctctggctccaactctgggaactcggccaccctgaccatcagcagagtcgacgccggggatgaggccgactattactgtcaggtgtgggatagtaggagtgatcatccttatgtcttcggaagtgggaccaagctcaccgtccta

SEQ ID NO: 1498 - protein, 109 aa, Artificial Sequence
  source: /note="Description of Artificial Sequence: Synthetic light chain variable region"
QSVVTQPPSVSVAPGKTAKITCGGNNIGSKSVYWYQQKPGQAPVLVMYYDTYRPSGIPERFSGSNSGNSATLTISRVDAGDEADYYCQVWDSRSDHPYVFGSGTKLTVL

SEQ ID NO: 1499 - protein, 11 aa, Artificial Sequence
  source: /note="Description of Artificial Sequence: Synthetic light chain variable region CDR L1"
GGNNIGSKSVY

SEQ ID NO: 1500 - DNA, 33 bp, Artificial Sequence
  source: /note="Description of Artificial Sequence: Synthetic light chain variable region CDR L1"
gggggaaacaacattggaagtaagagtgtgtac

SEQ ID NO: 1501 - protein, 7 aa, Artificial Sequence
  source: /note="Description of Artificial Sequence: Synthetic light chain variable region CDR L2"
YDTYRPS

SEQ ID NO: 1502 - DNA, 21 bp, Artificial Sequence
  source: /note="Description of Artificial Sequence: Synthetic light chain variable region CDR L2"
tatgatacttaccggccctca

SEQ ID NO: 1503 - protein, 12 aa, Artificial Sequence
  source: /note="Description of Artificial Sequence: Synthetic light chain variable region CDR L3"
QVWDSRSDHPYV

SEQ ID NO: 1504 - DNA, 36 bp, Artificial Sequence
  source: /note="Description of Artificial Sequence: Synthetic light chain variable region CDR L3"
caggtgtgggatagtaggagtgatcatccttatgtc

SEQ ID NO: 1505 - DNA, 384 bp, Artificial Sequence
  source: /note="Description of Artificial Sequence: Synthetic heavy chain variable region"
caggtccagctggtgcagtctggggctgaggtgaagaggcctgggtcgtcggtgaaggtctcctgcaaggcttctggaggcacgtccagcagttatattatcagttgggtgcgacaggcccctgggcaagggcttgagtggatgggagggatcatccccatccctatttctggcgcaccaacctacgcacagaagttccagggcagagcaaactatgcacagaagttcgagggcagactcacgattaccgcggacagactcacgagcacagcctacatggagctgagcagcctgacatctgaggacacggccgtgtattattgtgtaagagatgagaggaacgggggctattggggccagggaaccctggtcaccgtctcctca

SEQ ID NO: 1506 - protein, 128 aa, Artificial Sequence
  source: /note="Description of Artificial Sequence: Synthetic heavy chain variable region"
QVQLVQSGAEVKRPGSSVKVSCKASGGTSSSYIISWVRQAPGQGLEWMGGIIPIPISGAPTYAQKFQGRANYAQKFEGRLTITADRLTSTAYMELSSLTSEDTAVYYCVRDERNGGYWGQGTLVTVSS

SEQ ID NO: 1507 - protein, 9 aa, Artificial Sequence
  source: /note="Description of Artificial Sequence: Synthetic heavy chain variable region CDR H1"
GTSSSYIIS

SEQ ID NO: 1508 - DNA, 27 bp, Artificial Sequence
  source: /note="Description of Artificial Sequence: Synthetic heavy chain variable region CDR H1"
ggcacgtccagcagttatattatcagt

SEQ ID NO: 1509 - protein, 29 aa, Artificial Sequence
  source: /note="Description of Artificial Sequence: Synthetic heavy chain variable region CDR H2"
GIIPIPISGAPTYAQKFQGRANYAQKFEG

SEQ ID NO: 1510 - DNA, 87 bp, Artificial Sequence
  source: /note="Description of Artificial Sequence: Synthetic heavy chain variable region CDR H2"
gggatcatccccatccctatttctggcgcaccaacctacgcacagaagttccagggcagagcaaactatgcacagaagttcgagggc

SEQ ID NO: 1511 - protein, 9 aa, Artificial Sequence
  source: /note="Description of Artificial Sequence: Synthetic heavy chain variable region CDR H3"
VRDERNGGY

SEQ ID NO: 1512 - DNA, 27 bp, Artificial Sequence
  source: /note="Description of Artificial Sequence: Synthetic heavy chain variable region CDR H3"
gtaagagatgagaggaacgggggctat

SEQ ID NO: 1513 - DNA, 330 bp, Artificial Sequence
  source: /note="Description of Artificial Sequence: Synthetic light chain variable region"
cagtctgccctgactcagcctgcctccgtgtctgggtctcctggacagtcgatcaccatctcctgcactggaaccagcaatgacgttggtgcttataatcatgtgtcgtggtaccaacaacacccagggaaagcccccaaactcatgatctatgatgtcactaatcggccctcaggggtttctaatcgcttctctggctccaagtctggcaacacggcctccctgaccatctttgggctccagactgacgacgaggctgattattattgcagctcatatacaatcagcagcaccttggtgttcggcggagggacccagctgaccgtcctc

SEQ ID NO: 1514 - protein, 110 aa, Artificial Sequence
  source: /note="Description of Artificial Sequence: Synthetic light chain variable region"
QSALTQPASVSGSPGQSITISCTGTSNDVGAYNHVSWYQQHPGKAPKLMIYDVTNRPSGVSNRFSGSKSGNTASLTIFGLQTDDEADYYCSSYTISSTLVFGGGTQLTVL

SEQ ID NO: 1515 - protein, 14 aa, Artificial Sequence
  source: /note="Description of Artificial Sequence: Synthetic light chain variable region CDR L1"
TGTSNDVGAYNHVS

SEQ ID NO: 1516 - DNA, 42 bp, Artificial Sequence
  source: /note="Description of Artificial Sequence: Synthetic light chain variable region CDR L1"
actggaaccagcaatgacgttggtgcttataatcatgtgtcg

SEQ ID NO: 1517 - protein, 7 aa, Artificial Sequence
  source: /note="Description of Artificial Sequence: Synthetic light chain variable region CDR L2"
DVTNRPS

SEQ ID NO: 1518 - DNA, 21 bp, Artificial Sequence
  source: /note="Description of Artificial Sequence: Synthetic light chain variable region CDR L2"
gatgtcactaatcggccctca

SEQ ID NO: 1519 - protein, 10 aa, Artificial Sequence
  source: /note="Description of Artificial Sequence: Synthetic light chain variable region CDR L3"
SSYTISSTLV

SEQ ID NO: 1520 - DNA, 30 bp, Artificial Sequence
  source: /note="Description of Artificial Sequence: Synthetic light chain variable region CDR L3"
agctcatatacaatcagcagcaccttggtg

SEQ ID NO: 1521 - DNA, 360 bp, Artificial Sequence
  source: /note="Description of Artificial Sequence: Synthetic heavy chain variable region"
gaggtgcagctggtggagtctgggggaggcgtggtccagcctgggaggtccctgaggctctcctgtgcagcctctggattcaccttcagttcctatgcaatgcactgggtccgccaggctccaggcaagggcctggagtgggtggcagttatatcatatgatgaaggcaatgaatactacgcagactccgtgaagggccgattcaccatctccagagccaattccaagaacacgatttatctgcaaatgaacagcctgagagctgaggacacggctgtctattactgtgcgagagattacatacatggggactacggtttggacgtctggggcctagggaccacggtcaccgtctcctca

SEQ ID NO: 1522 - protein, 120 aa, Artificial Sequence
  source: /note="Description of Artificial Sequence: Synthetic heavy chain variable region"
EVQLVESGGGVVQPGRSLRLSCAASGFTFSSYAMHWVRQAPGKGLEWVAVISYDEGNEYYADSVKGRFTISRANSKNTIYLQMNSLRAEDTAVYYCARDYIHGDYGLDVWGLGTTVTVSS

SEQ ID NO: 1523 - protein, 9 aa, Artificial Sequence
  source: /note="Description of Artificial Sequence: Synthetic heavy chain variable region CDR H1"
FTFSSYAMH

SEQ ID NO: 1524 - DNA, 27 bp, Artificial Sequence
  source: /note="Description of Artificial Sequence: Synthetic heavy chain variable region CDR H1"
ttcaccttcagttcctatgcaatgcac

SEQ ID NO: 1525 - protein, 17 aa, Artificial Sequence
  source: /note="Description of Artificial Sequence: Synthetic heavy chain variable region CDR H2"
VISYDEGNEYYADSVKG

SEQ ID NO: 1526 - DNA, 51 bp, Artificial Sequence
  source: /note="Description of Artificial Sequence: Synthetic heavy chain variable region CDR H2"
gttatatcatatgatgaaggcaatgaatactacgcagactccgtgaagggc

SEQ ID NO: 1527 - protein, 13 aa, Artificial Sequence
  source: /note="Description of Artificial Sequence: Synthetic heavy chain variable region CDR H3"
ARDYIHGDYGLDV

SEQ ID NO: 1528 - DNA, 39 bp, Artificial Sequence
  source: /note="Description of Artificial Sequence: Synthetic heavy chain variable region CDR H3"
gcgagagattacatacatggggactacggtttggacgtc

SEQ ID NO: 1529 - DNA, 333 bp, Artificial Sequence
  source: /note="Description of Artificial Sequence: Synthetic light chain variable region"
gaaattgtgttgacacagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttactactgcatgcaacctctacaaacaatcaccttcggccaagggacacgactggagattaaa

SEQ ID NO: 1530 - protein, 111 aa, Artificial Sequence
  source: /note="Description of Artificial Sequence: Synthetic light chain variable region"
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQPLQTITFGQGTRLEIK

SEQ ID NO: 1531 - protein, 16 aa, Artificial Sequence
  source: /note="Description of Artificial Sequence: Synthetic light chain variable region CDR L1"
RSSQSLLHSNGYNYLD

SEQ ID NO: 1532 - DNA, 48 bp, Artificial Sequence
  source: /note="Description of Artificial Sequence: Synthetic light chain variable region CDR L1"
aggtctagtcagagcctcctgcatagtaatggatacaactatttggat

SEQ ID NO: 1533 - protein, 7 aa, Artificial Sequence
  source: /note="Description of Artificial Sequence: Synthetic light chain variable region CDR L2"
LGSNRAS

SEQ ID NO: 1534 - DNA, 21 bp, Artificial Sequence
  source: /note="Description of Artificial Sequence: Synthetic light chain variable region CDR L2"
ttgggttctaatcgggcctcc

SEQ ID NO: 1535 - protein, 8 aa, Artificial Sequence
  source: /note="Description of Artificial Sequence: Synthetic light chain variable region CDR L3"
MQPLQTIT

SEQ ID NO: 1536 - DNA, 24 bp, Artificial Sequence
  source: /note="Description of Artificial Sequence: Synthetic light chain variable region CDR L3"
atgcaacctctacaaacaatcacc

SEQ ID NO: 1537 - DNA, 357 bp, Artificial Sequence
  source: /note="Description of Artificial Sequence: Synthetic heavy chain variable region"
caggtccagctggtgcagtctggggctgaggtgaagaagcctggggcctcagtgaaggtctcctgcaaggcttctggatacaccttcaccgactactatatgcactgggtgcgacaggcccctggacaagggcttgagtgggtgggatggatcaaccctaacagtggttccacaaactatgcacagaagtttcagggcagggtcaccgtgaccagggacacgtccatcagcacagcctacatggacctgagcagactgagatctgacgacacggccgtgtattactgtgcgagcaggagctgggaccatgatgcttttgatatctggggccaagggacaatggtcactgtctcctca

SEQ ID NO: 1538 - protein, 119 aa, Artificial Sequence
  source: /note="Description of Artificial Sequence: Synthetic heavy chain variable region"
QVQLVQSGAEVKKPGASVKVSCKASGYTFTDYYMHWVRQAPGQGLEWVGWINPNSGSTNYAQKFQGRVTVTRDTSISTAYMDLSRLRSDDTAVYYCASRSWDHDAFDIWGQGTMVTVSS

SEQ ID NO: 1539 - protein, 9 aa, Artificial Sequence
  source: /note="Description of Artificial Sequence: Synthetic heavy chain variable region CDR H1"
YTFTDYYMH

SEQ ID NO: 1540 - DNA, 27 bp, Artificial Sequence
  source: /note="Description of Artificial Sequence: Synthetic heavy chain variable region CDR H1"
tacaccttcaccgactactatatgcac

SEQ ID NO: 1541 - protein, 17 aa, Artificial Sequence
  source: /note="Description of Artificial Sequence: Synthetic heavy chain variable region CDR H2"
WINPNSGSTNYAQKFQG

SEQ ID NO: 1542 - DNA, 51 bp, Artificial Sequence
  source: /note="Description of Artificial Sequence: Synthetic heavy chain variable region CDR H2"
tggatcaaccctaacagtggttccacaaactatgcacagaagtttcagggc

SEQ ID NO: 1543 - protein, 12 aa, Artificial Sequence
  source: /note="Description of Artificial Sequence: Synthetic heavy chain variable region CDR H3"
ASRSWDHDAFDI

SEQ ID NO: 1544 - DNA, 36 bp, Artificial Sequence
  source: /note="Description of Artificial Sequence: Synthetic heavy chain variable region CDR H3"
gcgagcaggagctgggaccatgatgcttttgatatc

SEQ ID NO: 1545 - DNA, 330 bp, Artificial Sequence
  source: /note="Description of Artificial Sequence: Synthetic light chain variable region"
cagtctgtcttgacgcagccgccctcagtgtctggggccccagggcagagggtcaccatctcctgcactgggagtagctccaacatcggggcaggttatgatgtacactggtaccagcagcttccaggaagagcccccaaactcctcatctttggtaacagcaatcggccctcaggggtccctgaccgattctctggctccaagtctggcacctcagcctccctggccatcactgggctccagcctgaggatgaggctgattattactgccactgctatgacagcaggctgagtgtggtcttcggcggagggaccaagctcaccgtccta

SEQ ID NO: 1546 - protein, 110 aa, Artificial Sequence
  source: /note="Description of Artificial Sequence: Synthetic light chain variable region"
QSVLTQPPSVSGAPGQRVTISCTGSSSNIGAGYDVHWYQQLPGRAPKLLIFGNSNRPSGVPDRFSGSKSGTSASLAITGLQPEDEADYYCHCYDSRLSVVFGGGTKLTVL

SEQ ID NO: 1547 - protein, 14 aa, Artificial Sequence
  source: /note="Description of Artificial Sequence: Synthetic light chain variable region CDR L1"
TGSSSNIGAGYDVH

SEQ ID NO: 1548 - DNA, 42 bp, Artificial Sequence
  source: /note="Description of Artificial Sequence: Synthetic light chain variable region CDR L1"
actgggagtagctccaacatcggggcaggttatgatgtacac

SEQ ID NO: 1549 - protein, 7 aa, Artificial Sequence
  source: /note="Description of Artificial Sequence: Synthetic light chain variable region CDR L2"
GNSNRPS

SEQ ID NO: 1550 - DNA, 21 bp, Artificial Sequence
  source: /note="Description of Artificial Sequence: Synthetic light chain variable region CDR L2"
ggtaacagcaatcggccctca

SEQ ID NO: 1551 - protein, 10 aa, Artificial Sequence
  source: /note="Description of Artificial Sequence: Synthetic light chain variable region CDR L3"
HCYDSRLSVV

SEQ ID NO: 1552 - DNA, 30 bp, Artificial Sequence
  source: /note="Description of Artificial Sequence: Synthetic light chain variable region CDR L3"
cactgctatgacagcaggctgagtgtggtc

SEQ ID NO: 1553 - DNA, 378 bp, Artificial Sequence
  source: /note="Description of Artificial Sequence: Synthetic heavy chain variable region"
caggtccagctggtacagtctgggactgaggtgaagaagcctgggtcttcggtgaaggtctcctgcaaggcttcgggaggcaccttcagtagctatgctatcagctgggtgcgacaggcccctggacaagggcttgagtggatgggagggatccaccctacctctggtccagcaaattacgcacagaagttccaggatagagtcaccattaccgtggacaagtccacgagcacagtctacatggacctgagcagcctgagatctgaggacacggccgtgtattactgtgcgagagttggtgtgggtcgcacttggatatatgatacaatgggttaccttgacttctggggccagggaaccctggtcaccgtctcttca

SEQ ID NO: 1554 - protein, 126 aa, Artificial Sequence
  source: /note="Description of Artificial Sequence: Synthetic heavy chain variable region"
QVQLVQSGTEVKKPGSSVKVSCKASGGTFSSYAISWVRQAPGQGLEWMGGIHPTSGPANYAQKFQDRVTITVDKSTSTVYMDLSSLRSEDTAVYYCARVGVGRTWIYDTMGYLDFWGQGTLVTVSS

SEQ ID NO: 1555 - protein, 9 aa, Artificial Sequence
  source: /note="Description of Artificial Sequence: Synthetic heavy chain variable region CDR H1"
GTFSSYAIS

SEQ ID NO: 1556 - DNA, 27 bp, Artificial Sequence
  source: /note="Description of Artificial Sequence: Synthetic heavy chain variable region CDR H1"
ggcaccttcagtagctatgctatcagc

SEQ ID NO: 1557 - protein, 17 aa, Artificial Sequence
  source: /note="Description of Artificial Sequence: Synthetic heavy chain variable region CDR H2"
GIHPTSGPANYAQKFQD

SEQ ID NO: 1558 - DNA, 51 bp, Artificial Sequence
  source: /note="Description of Artificial Sequence: Synthetic heavy chain variable region CDR H2"
gggatccaccctacctctggtccagcaaattacgcacagaagttccaggat

SEQ ID NO: 1559 - protein, 19 aa, Artificial Sequence
  source: /note="Description of Artificial Sequence: Synthetic heavy chain variable region CDR H3"
ARVGVGRTWIYDTMGYLDF

SEQ ID NO: 1560 - DNA, 57 bp, Artificial Sequence
  source: /note="Description of Artificial Sequence: Synthetic heavy chain variable region CDR H3"
gcgagagttggtgtgggtcgcacttggatatatgatacaatgggttaccttgacttc

SEQ ID NO: 1561 - DNA, 324 bp, Artificial Sequence
  source: /note="Description of Artificial Sequence: Synthetic light chain variable region"
gaaattgtgatgacacagtctccagccacgctgtctttgtctccaggagaaagagccaccctctcctgcagggccagtcagagtgttagcgactacttagcctggtaccaacaaaaacctggccaggctcccaggctcctcatctatgatgcatccaacagggccactggcatcccagccaggttcagtggcagtgggtctgggacagacttcactctcaccatcaccagcctagagcctgaagattttgcagtttattactgtcagcaccgtagcgactggccttccctcactttcggcggagggaccaagctggagatcaaa

SEQ ID NO: 1562 - protein, 108 aa, Artificial Sequence
  source: /note="Description of Artificial Sequence: Synthetic light chain variable region"
EIVMTQSPATLSLSPGERATLSCRASQSVSDYLAWYQQKPGQAPRLLIYDASNRATGIPARFSGSGSGTDFTLTITSLEPEDFAVYYCQHRSDWPSLTFGGGTKLEIK

SEQ ID NO: 1563 - protein, 11 aa, Artificial Sequence
  source: /note="Description of Artificial Sequence: Synthetic light chain variable region CDR L1"
RASQSVSDYLA

SEQ ID NO: 1564 - DNA, 33 bp, Artificial Sequence
  source: /note="Description of Artificial Sequence: Synthetic light chain variable region CDR L1"
agggccagtcagagtgttagcgactacttagcc

SEQ ID NO: 1565 - protein, 7 aa, Artificial Sequence
  source: /note="Description of Artificial Sequence: Synthetic light chain variable region CDR L2"
DASNRAT

SEQ ID NO: 1566 - DNA, 21 bp, Artificial Sequence
  source: /note="Description of Artificial Sequence: Synthetic light chain variable region CDR L2"
gatgcatccaacagggccact

SEQ ID NO: 1567 - protein, 10 aa, Artificial Sequence
  source: /note="Description of Artificial Sequence: Synthetic light chain variable region CDR L3"
QHRSDWPSLT

SEQ ID NO: 1568 - DNA, 30 bp, Artificial Sequence
  source: /note="Description of Artificial Sequence: Synthetic light chain variable region CDR L3"
cagcaccgtagcgactggccttccctcact

SEQ ID NO: 1569 - DNA, 366 bp, Artificial Sequence
  source: /note="Description of Artificial Sequence: Synthetic heavy chain variable region"
gaggtgcagctggtggagtctgggggaggcttggtacagcctggcaggtccctgagactctcctgtgtaacttcgggattcggctttgatgactatgccatgcactgggtccggcaagccccagggaagggcctggagtgggtctcagggattggttggaatagtggtggcataggctatgcggactctgtgaagggccgattctccatctccagagacaacgccaagaactccttgtatctacaaatgaacagtctgagacctgaagacactgccttctattactgtgtaaaagatgggacccctatagcagtggctggatactttgaatactggggccagggaaccctggtcaccgtctcctca

SEQ ID NO: 1570 - protein, 122 aa, Artificial Sequence
  source: /note="Description of Artificial Sequence: Synthetic heavy chain variable region"
EVQLVESGGGLVQPGRSLRLSCVTSGFGFDDYAMHWVRQAPGKGLEWVSGIGWNSGGIGYADSVKGRFSISRDNAKNSLYLQMNSLRPEDTAFYYCVKDGTPIAVAGYFEYWGQGTLVTVSS

SEQ ID NO: 1571 - protein, 9 aa, Artificial Sequence
  source: /note="Description of Artificial Sequence: Synthetic heavy chain variable region CDR H1"
FGFDDYAMH

SEQ ID NO: 1572 - DNA, 27 bp, Artificial Sequence
  source: /note="Description of Artificial Sequence: Synthetic heavy chain variable region CDR H1"
ttcggctttgatgactatgccatgcac

SEQ ID NO: 1573 - protein, 17 aa, Artificial Sequence
  source: /note="Description of Artificial Sequence: Synthetic heavy chain variable region CDR H2"
GIGWNSGGIGYADSVKG

SEQ ID NO: 1574 - DNA, 51 bp, Artificial Sequence
  source: /note="Description of Artificial Sequence: Synthetic heavy chain variable region CDR H2"
gggattggttggaatagtggtggcataggctatgcggactctgtgaagggc

SEQ ID NO: 1575 - protein, 15 aa, Artificial Sequence
  source: /note="Description of Artificial Sequence: Synthetic heavy chain variable region CDR H3"
VKDGTPIAVAGYFEY

SEQ ID NO: 1576 - DNA, 45 bp, Artificial Sequence
  source: /note="Description of Artificial Sequence: Synthetic heavy chain variable region CDR H3"
gtaaaagatgggacccctatagcagtggctggatactttgaatac

SEQ ID NO: 1577 - DNA, 330 bp, Artificial Sequence
  source: /note="Description of Artificial Sequence: Synthetic light chain variable region"
tcctatgagctgacacagccgccctcagcgtctggtacccccgggcagagggtcaccatctcttgttctggaggcaggtccaacatcggaaataattatgtatactggtaccagcagctcccaggaacggcccccaaactcctcatctataggcatgatcagcggccctcaggggtccctgaccgattctctggctccaagtctggcacctcagcctccctggccatcaatgggctccggtccgaggatgaggctgactatttttgcgcagtatgggatgacagcctgagttgttatgtcttcggagctgggaccaagctcaccgtccta

SEQ ID NO: 1578 - protein, 110 aa, Artificial Sequence
  source: /note="Description of Artificial Sequence: Synthetic light chain variable region"
SYELTQPPSASGTPGQRVTISCSGGRSNIGNNYVYWYQQLPGTAPKLLIYRHDQRPSGVPDRFSGSKSGTSASLAINGLRSEDEADYFCAVWDDSLSCYVFGAGTKLTVL

SEQ ID NO: 1579 - protein, 13 aa, Artificial Sequence
  source: /note="Description of Artificial Sequence: Synthetic light chain variable region CDR L1"
SGGRSNIGNNYVY

SEQ ID NO: 1580 - DNA, 39 bp, Artificial Sequence
  source: /note="Description of Artificial Sequence: Synthetic light chain variable region CDR L1"
tctggaggcaggtccaacatcggaaataattatgtatac

SEQ ID NO: 1581 - protein, 7 aa, Artificial Sequence
  source: /note="Description of Artificial Sequence: Synthetic light chain variable region CDR L2"
RHDQRPS

SEQ ID NO: 1582 - DNA, 21 bp, Artificial Sequence
  source: /note="Description of Artificial Sequence: Synthetic light chain variable region CDR L2"
aggcatgatcagcggccctca

SEQ ID NO: 1583 - protein, 11 aa, Artificial Sequence
  source: /note="Description of Artificial Sequence: Synthetic light chain variable region CDR L3"
AVWDDSLSCYV

SEQ ID NO: 1584 - DNA, 33 bp, Artificial Sequence
  source: /note="Description of Artificial Sequence: Synthetic light chain variable region CDR L3"
gcagtatgggatgacagcctgagttgttatgtc

SEQ ID NO: 1585 - DNA, 369 bp, Artificial Sequence
  source: /note="Description of Artificial Sequence: Synthetic heavy chain variable region"
caggtccagctggtgcagtctggggctgaggtgaagaagcctgggtcctcggtgaaggtctcctgcaaggcctctggaggcaccttcagcacctatggtatcagctgggtgcgacaggcccctggacaaggtcttgagtggatgggaagggtcatccctatgtttggaacagcaacctacgcacagaagttccaggacagagtcacgattaccgcggacaaagccacgagcacggcgtacatggagctgaacagcctgagatctgacgacacggccgtatattactgtgcgagatgtcctccttttgagggagttcgtccgccctggttcgacccctggggccagggaaccctggtcaccgtctcttca

SEQ ID NO: 1586 - protein, 123 aa, Artificial Sequence
  source: /note="Description of Artificial Sequence: Synthetic heavy chain variable region"
QVQLVQSGAEVKKPGSSVKVSCKASGGTFSTYGISWVRQAPGQGLEWMGRVIPMFGTATYAQKFQDRVTITADKATSTAYMELNSLRSDDTAVYYCARCPPFEGVRPPWFDPWGQGTLVTVSS

SEQ ID NO: 1587 - protein, 9 aa, Artificial Sequence
  source: /note="Description of Artificial Sequence: Synthetic heavy chain variable region CDR H1"
GTFSTYGIS

SEQ ID NO: 1588 - DNA, 27 bp, Artificial Sequence
  source: /note="Description of Artificial Sequence: Synthetic heavy chain variable region CDR H1"
ggcaccttcagcacctatggtatcagc

SEQ ID NO: 1589 - protein, 17 aa, Artificial Sequence
  source: /note="Description of Artificial Sequence: Synthetic heavy chain variable region CDR H2"
RVIPMFGTATYAQKFQD

SEQ ID NO: 1590 - DNA, 51 bp, Artificial Sequence
  source: /note="Description of Artificial Sequence: Synthetic heavy chain variable region CDR H2"
agggtcatccctatgtttggaacagcaacctacgcacagaagttccaggac

SEQ ID NO: 1591 - protein, 16 aa, Artificial Sequence
  source: /note="Description of Artificial Sequence: Synthetic heavy chain variable region CDR H3"
ARCPPFEGVRPPWFDP

SEQ ID NO: 1592 - DNA, 48 bp, Artificial Sequence
  source: /note="Description of Artificial Sequence: Synthetic heavy chain variable region CDR H3"
gcgagatgtcctccttttgagggagttcgtccgccctggttcgacccc

SEQ ID NO: 1593 - DNA, 324 bp, Artificial Sequence
  source: /note="Description of Artificial Sequence: Synthetic light chain variable region"
tcctatgagctgactcagccaccctcggtgtcagtggccccaggacggacggccaagattacctgtgggggatacaacattggaaataaacgtgtgcactggtaccggcagaggccaggccaggccccagtgctgatcgtctatgataatgccgaccggccctcagggatccctgagcgattctctggctccaactctgggaacacggccaccctgaccatcagcaacgtcgcagccggggatgaggccgactatcactgtcaggtgtgggaaactagtagtgatcatccggtattcggcggagggaccaagctcaccgtccta

SEQ ID NO: 1594 - protein, 108 aa, Artificial Sequence
  source: /note="Description of Artificial Sequence: Synthetic light chain variable region"
SYELTQPPSVSVAPGRTAKITCGGYNIGNKRVHWYRQRPGQAPVLIVYDNADRPSGIPERFSGSNSGNTATLTISNVAAGDEADYHCQVWETSSDHPVFGGGTKLTVL

SEQ ID NO: 1595 - protein, 11 aa, Artificial Sequence
  source: /note="Description of Artificial Sequence: Synthetic light chain variable region CDR L1"
GGYNIGNKRVH

SEQ ID NO: 1596 - DNA, 33 bp, Artificial Sequence
  source: /note="Description of Artificial Sequence: Synthetic light chain variable region CDR L1"
gggggatacaacattggaaataaacgtgtgcac

SEQ ID NO: 1597 - protein, 7 aa, Artificial Sequence
  source: /note="Description of Artificial Sequence: Synthetic light chain variable region CDR L2"
DNADRPS

SEQ ID NO: 1598 - DNA, 21 bp, Artificial Sequence
  source: /note="Description of Artificial Sequence: Synthetic light chain variable region CDR L2"
gataatgccgaccggccctca

SEQ ID NO: 1599 - protein, 11 aa, Artificial Sequence
  source: /note="Description of Artificial Sequence: Synthetic light chain variable region CDR L3"
QVWETSSDHPV

SEQ ID NO: 1600 - DNA, 33 bp, Artificial Sequence
  source: /note="Description of Artificial Sequence: Synthetic light chain variable region CDR L3"
caggtgtgggaaactagtagtgatcatccggta

SEQ ID NO: 1601 - DNA, 354 bp, Artificial Sequence
  source: /note="Description of Artificial Sequence: Synthetic heavy chain variable region"
gaggtgcagctggtgcagtctggaacagaggtgaaaaagcccggggaatctctgaagatctcttgtaaggcttctggatacagctctttccccaattggatcggctgggtgcgccagatgcccgggaaaggcctggagtacatggggtccatctttcctgatgactctaataccagatatagtccgtccttccgaggcctggtcgccatctcagccgacaagtccctgagaaccgcctatctgcagtggagcagcctgaaggcctcggacagcgccatatattactgtgcgagagggcccttcccgcactactttgactcctggggtcagggaaccctggtcaccgtctcctca

SEQ ID NO: 1602 - protein, 118 aa, Artificial Sequence
  source: /note="Description of Artificial Sequence: Synthetic heavy chain variable region"
EVQLVQSGTEVKKPGESLKISCKASGYSSFPNWIGWVRQMPGKGLEYMGSIFPDDSNTRYSPSFRGLVAISADKSLRTAYLQWSSLKASDSAIYYCARGPFPHYFDSWGQGTLVTVSS

SEQ ID NO: 1603 - protein, 9 aa, Artificial Sequence
  source: /note="Description of Artificial Sequence: Synthetic heavy chain variable region CDR H1"
YSSFPNWIG

SEQ ID NO: 1604 - DNA, 27 bp, Artificial Sequence
  source: /note="Description of Artificial Sequence: Synthetic heavy chain variable region CDR H1"
tacagctctttccccaattggatcggc

SEQ ID NO: 1605 - protein, 17 aa, Artificial Sequence
  source: /note="Description of Artificial Sequence: Synthetic heavy chain variable region CDR H2"
SIFPDDSNTRYSPSFRG

SEQ ID NO: 1606 - DNA, 51 bp, Artificial Sequence
  source: /note="Description of Artificial Sequence: Synthetic heavy chain variable region CDR H2"
tccatctttcctgatgactctaataccagatatagtccgtccttccgaggc

SEQ ID NO: 1607 - protein, 11 aa, Artificial Sequence
  source: /note="Description of Artificial Sequence: Synthetic heavy chain variable region CDR H3"
ARGPFPHYFDS

SEQ ID NO: 1608 - DNA, 33 bp, Artificial Sequence
  source: /note="Description of Artificial Sequence: Synthetic heavy chain variable region CDR H3"
gcgagagggcccttcccgcactactttgactcc

SEQ ID NO: 1609 - DNA, 333 bp, Artificial Sequence
  source: /note="Description of Artificial Sequence: Synthetic light chain variable region"
aattttatgctgactcagccccactctgtgtcggagtctccggggaagacggtcaccatctcctgcacccgcagcagtggcagtattgcccgcaactatgtgcagtggtaccagcagcgcccgggcagttcccccaccactgtgatctatgaggatgaccaaagaccccctggggtccctgatcggttctctggctccatcgacagctcctccaactctgcctccctcaccatctctggactgcagactgaggacgaggctgactactactgtcagtcttatgatcccaccaatcaaaatgtcttcggaactgggaccaagctcaccgtccta

SEQ ID NO: 1610 - protein, 111 aa, Artificial Sequence
  source: /note="Description of Artificial Sequence: Synthetic light chain variable region"
NFMLTQPHSVSESPGKTVTISCTRSSGSIARNYVQWYQQRPGSSPTTVIYEDDQRPPGVPDRFSGSIDSSSNSASLTISGLQTEDEADYYCQSYDPTNQNVFGTGTKLTVL

SEQ ID NO: 1611 - protein, 13 aa, Artificial Sequence
  source: /note="Description of Artificial Sequence: Synthetic light chain variable region CDR L1"
TRSSGSIARNYVQ

SEQ ID NO: 1612 - DNA, 39 bp, Artificial Sequence
  source: /note="Description of Artificial Sequence: Synthetic light chain variable region CDR L1"
acccgcagcagtggcagtattgcccgcaactatgtgcag

SEQ ID NO: 1613 - protein, 7 aa, Artificial Sequence
  source: /note="Description of Artificial Sequence: Synthetic light chain variable region CDR L2"
EDDQRPP

SEQ ID NO: 1614 - DNA, 21 bp, Artificial Sequence
  source: /note="Description of Artificial Sequence: Synthetic light chain variable region CDR L2"
gaggatgaccaaagaccccct

SEQ ID NO: 1615 - protein, 10 aa, Artificial Sequence
  source: /note="Description of Artificial Sequence: Synthetic light chain variable region CDR L3"
QSYDPTNQNV

SEQ ID NO: 1616 - DNA, 30 bp, Artificial Sequence
  source: /note="Description of Artificial Sequence: Synthetic light chain variable region CDR L3"
cagtcttatgatcccaccaatcaaaatgtc

SEQ ID NO: 1617 - DNA, 363 bp, Artificial Sequence
  source: /note="Description of Artificial Sequence: Synthetic heavy chain variable region"
gaggtgcagctggtggagtctgggggaggcgtggtccagcctgggaggtccctgagactctcctgtgaagcctctggattcaacttccataattatgatatacaatgggtccgccaggccccaggcaaggggctggagtgggtggcactagtattatttgatggaagcaaaaaatattatccacactctgtgaagggccgattcgccatctccagagacaactccaaaaaaactctatttctgcaaatgaacagcctgagacctgaggacacggctgtgtattactgtgcgagagccccagtgactggcgcctcgtattaccttgactattggggccagggaaccctggtcaccgtctcctca

SEQ ID NO: 1618 - protein, 121 aa, Artificial Sequence
  source: /note="Description of Artificial Sequence: Synthetic heavy chain variable region"
EVQLVESGGGVVQPGRSLRLSCEASGFNFHNYDIQWVRQAPGKGLEWVALVLFDGSKKYYPHSVKGRFAISRDNSKKTLFLQMNSLRPEDTAVYYCARAPVTGASYYLDYWGQGTLVTVSS

SEQ ID NO: 1619 - protein, 9 aa, Artificial Sequence
  source: /note="Description of Artificial Sequence: Synthetic heavy chain variable region CDR H1"
FNFHNYDIQ

SEQ ID NO: 1620 - DNA, 27 bp, Artificial Sequence
  source: /note="Description of Artificial Sequence: Synthetic heavy chain variable region CDR H1"
ttcaacttccataattatgatatacaa

SEQ ID NO: 1621 - protein, 17 aa, Artificial Sequence
  source: /note="Description of Artificial Sequence: Synthetic heavy chain variable region CDR H2"
LVLFDGSKKYYPHSVKG

SEQ ID NO: 1622 - DNA, 51 bp, Artificial Sequence
  source: /note="Description of Artificial Sequence: Synthetic heavy chain variable region CDR H2"
ctagtattatttgatggaagcaaaaaatattatccacactctgtgaagggc

SEQ ID NO: 1623 - protein, 14 aa, Artificial Sequence
  source: /note="Description of Artificial Sequence: Synthetic heavy chain variable region CDR H3"
ARAPVTGASYYLDY

SEQ ID NO: 1624 - DNA, 42 bp, Artificial Sequence
  source: /note="Description of Artificial Sequence: Synthetic heavy chain variable region CDR H3"
gcgagagccccagtgactggcgcctcgtattaccttgactat

SEQ ID NO: 1625 - DNA, 324 bp, Artificial Sequence
  source: /note="Description of Artificial Sequence: Synthetic light chain variable region"
tcctatgtgctgacacagccaccctcggtgtcagtggccccaggacagacggccagaattacctgtggggcaaacaacattggaaataaaggtgtgcactggtaccaacagaagccaggccaggcccctgtgctggtcgtctatgatgatgacgaccagccctcagggatccctgagcgattctctggctccaactctgggaacacggccaccctgaccatcagcagggtcgaagccggggatgaggccgactattactgtcaggtgtgggatagtactagtgatcatctggtattcggcggagggacccagctgaccgtccta

SEQ ID NO: 1626 - protein, 108 aa, Artificial Sequence
  source: /note="Description of Artificial Sequence: Synthetic light chain variable region"
SYVLTQPPSVSVAPGQTARITCGANNIGNKGVHWYQQKPGQAPVLVVYDDDDQPSGIPERFSGSNSGNTATLTISRVEAGDEADYYCQVWDSTSDHLVFGGGTQLTVL

SEQ ID NO: 1627 - protein, 11 aa, Artificial Sequence
  source: /note="Description of Artificial Sequence: Synthetic light chain variable region CDR L1"
GANNIGNKGVH

SEQ ID NO: 1628 - DNA, 33 bp, Artificial Sequence
  source: /note="Description of Artificial Sequence: Synthetic light chain variable region CDR L1"
ggggcaaacaacattggaaataaaggtgtgcac

SEQ ID NO: 1629 - protein, 7 aa, Artificial Sequence
  source: /note="Description of Artificial Sequence: Synthetic light chain variable region CDR L2"
DDDDQPS

SEQ ID NO: 1630 - DNA, 21 bp, Artificial Sequence
  source: /note="Description of Artificial Sequence: Synthetic light chain variable region CDR L2"
gatgatgacgaccagccctca

SEQ ID NO: 1631 - protein, 11 aa, Artificial Sequence
  source: /note="Description of Artificial Sequence: Synthetic light chain variable region CDR L3"
QVWDSTSDHLV

SEQ ID NO: 1632 - DNA, 33 bp, Artificial Sequence
  source: /note="Description of Artificial Sequence: Synthetic light chain variable region CDR L3"
caggtgtgggatagtactagtgatcatctggta

SEQ ID NO: 1633 - DNA, 375 bp, Artificial Sequence
  source: /note="Description of Artificial Sequence: Synthetic heavy chain variable region"
caggtgcagctgcaggagtcgggcccaggactggtgaagccttcggagaccctgtccctcacctgcactgtctctggtggctccgtcagcagagggagttactactggacctggatccggcagcccccagggaagggactggagtggattggctatatctattacagtgggagcaccaactacaacccctccctcaagagtcgagtcaccatatcagtagacacgtccaagaaccagttctccctgaagctgagctctgtgaccgctgcggacacggccgtttattactgtgcgagagatataggggaagataagtatggtacttactacggtatggacgtctggggccaagggaccacggtcaccgtctcttca

SEQ ID NO: 1634 - protein, 125 aa, Artificial Sequence
  source: /note="Description of Artificial Sequence: Synthetic heavy chain variable region"
QVQLQESGPGLVKPSETLSLTCTVSGGSVSRGSYYWTWIRQPPGKGLEWIGYIYYSGSTNYNPSLKSRVTISVDTSKNQFSLKLSSVTAADTAVYYCARDIGEDKYGTYYGMDVWGQGTTVTVSS

SEQ ID NO: 1635 - protein, 11 aa, Artificial Sequence
  source: /note="Description of Artificial Sequence: Synthetic heavy chain variable region CDR H1"
GSVSRGSYYWT

SEQ ID NO: 1636 - DNA, 33 bp, Artificial Sequence
  source: /note="Description of Artificial Sequence: Synthetic heavy chain variable region CDR H1"
ggctccgtcagcagagggagttactactggacc

SEQ ID NO: 1637 - protein, 16 aa, Artificial Sequence
  source: /note="Description of Artificial Sequence: Synthetic heavy chain variable region CDR H2"
YIYYSGSTNYNPSLKS

SEQ ID NO: 1638 - DNA, 48 bp, Artificial Sequence
  source: /note="Description of Artificial Sequence: Synthetic heavy chain variable region CDR H2"
tatatctattacagtgggagcaccaactacaacccctccctcaagagt

SEQ ID NO: 1639 - protein, 17 aa, Artificial Sequence
  source: /note="Description of Artificial Sequence: Synthetic heavy chain variable region CDR H3"
ARDIGEDKYGTYYGMDV

SEQ ID NO: 1640 - DNA, 51 bp, Artificial Sequence
  source: /note="Description of Artificial Sequence: Synthetic heavy chain variable region CDR H3"
gcgagagatataggggaagataagtatggtacttactacggtatggacgtc

SEQ ID NO: 1641 - DNA, 324 bp, Artificial Sequence
  source: /note="Description of Artificial Sequence: Synthetic light chain variable region"
gaaattgtgatgacacagtctccagccaccctgtctttgtctccaggagaaagagccaccctctcctgcagggccagtcagagtgttagcagctccttagcctggtaccaacagaaacctggccaggctcccaggctcctcatctatggtgcatccaacagggccactggcatcccagccaggttcagtggcagtgggtctgggacagacttcactctcaccatcagtagcctagagcctgaggattttgcagtttattactgtcagcagcgtaccaactggcccccggtcactttcggccctgggaccaaggtggaaatcaaa

SEQ ID NO: 1642 - protein, 108 aa, Artificial Sequence
  source: /note="Description of Artificial Sequence: Synthetic light chain variable region"
EIVMTQSPATLSLSPGERATLSCRASQSVSSSLAWYQQKPGQAPRLLIYGASNRATGIPARFSGSGSGTDFTLTISSLEPEDFAVYYCQQRTNWPPVTFGPGTKVEIK

SEQ ID NO: 1643 - protein, 11 aa, Artificial Sequence
  source: /note="Description of Artificial Sequence: Synthetic light chain variable region CDR L1"
RASQSVSSSLA

SEQ ID NO: 1644 - DNA, 33 bp, Artificial Sequence
  source: /note="Description of Artificial Sequence: Synthetic light chain variable region CDR L1"
agggccagtcagagtgttagcagctccttagcc

SEQ ID NO: 1645 - protein, 7 aa, Artificial Sequence
  source: /note="Description of Artificial Sequence: Synthetic light chain variable region CDR L2"
GASNRAT

SEQ ID NO: 1646 - DNA, 21 bp, Artificial Sequence
  source: /note="Description of Artificial Sequence: Synthetic light chain variable region CDR L2"
ggtgcatccaacagggccact

SEQ ID NO: 1647 - protein, 10 aa, Artificial Sequence
  source: /note="Description of Artificial Sequence: Synthetic light chain variable region CDR L3"
QQRTNWPPVT

SEQ ID NO: 1648 - DNA, 30 bp, Artificial Sequence
  source: /note="Description of Artificial Sequence: Synthetic light chain variable region CDR L3"
cagcagcgtaccaactggcccccggtcact

SEQ ID NO: 1649 - DNA, 366 bp, Artificial Sequence
  source: /note="Description of Artificial Sequence: Synthetic heavy chain variable region"
caggtccagctggtacagtctgggggaggcctggtcaagcctggggggtccctgagactctcttgtgcagcctctggattcaccttcagtagctataccatgaactgggtccgccaggctccagggaaggggctggagtgggtctcatccattactggtggtagtagtttcacaaactacgcagactcactggagggccgattcaccatctccagagataacgccaagagctcactttttctgcaaatgaacagcctgagagtcgaggacacggctgtatattactgtgcgagagatcagccggggacgatttttggagtggtccaggactactggggccagggaaccctggtcaccgtctcctca

SEQ ID NO: 1650 - protein, 122 aa, Artificial Sequence
  source: /note="Description of Artificial Sequence: Synthetic heavy chain variable region"
QVQLVQSGGGLVKPGGSLRLSCAASGFTFSSYTMNWVRQAPGKGLEWVSSITGGSSFTNYADSLEGRFTISRDNAKSSLFLQMNSLRVEDTAVYYCARDQPGTIFGVVQDYWGQGTLVTVSS

SEQ ID NO: 1651 - protein, 9 aa, Artificial Sequence
  source: /note="Description of Artificial Sequence: Synthetic heavy chain variable region CDR H1"
FTFSSYTMN

SEQ ID NO: 1652 - DNA, 27 bp, Artificial Sequence
  source: /note="Description of Artificial Sequence: Synthetic heavy chain variable region CDR H1"
ttcaccttcagtagctataccatgaac

SEQ ID NO: 1653 - protein, 17 aa, Artificial Sequence
  source: /note="Description of Artificial Sequence: Synthetic heavy chain variable region CDR H2"
SITGGSSFTNYADSLEG

SEQ ID NO: 1654 - DNA, 51 bp, Artificial Sequence
  source: /note="Description of Artificial Sequence: Synthetic heavy chain variable region CDR H2"
tccattactggtggtagtagtttcacaaactacgcagactcactggagggc

SEQ ID NO: 1655 - protein, 15 aa, Artificial Sequence
  source: /note="Description of Artificial Sequence: Synthetic heavy chain variable region CDR H3"
ARDQPGTIFGVVQDY

SEQ ID NO: 1656 - DNA, 45 bp, Artificial Sequence
  source: /note="Description of Artificial Sequence: Synthetic heavy chain variable region CDR H3"
gcgagagatcagccggggacgatttttggagtggtccaggactac

SEQ ID NO: 1657 - DNA, 330 bp, Artificial Sequence
  source: /note="Description of Artificial Sequence: Synthetic light chain variable region"
cagtctgtcttgacgcagccgccctcagtgtctggggccccagggcagagggtcaccatctcctgcactgggggcagctccaacatcggggcaggttatgatgtgcactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagccgcctgagtgtggtattcggcggagggaccaaggtgaccgtccta

SEQ ID NO: 1658 - protein, 110 aa, Artificial Sequence
  source: /note="Description of Artificial Sequence: Synthetic light chain variable region"
QSVLTQPPSVSGAPGQRVTISCTGGSSNIGAGYDVHWYQQLPGTAPKLLIYGNSNRPSGVPDRFSGSKSGTSASLAITGLQAEDEADYYCQSYDSRLSVVFGGGTKVTVL

SEQ ID NO: 1659 - protein, 14 aa, Artificial Sequence
  source: /note="Description of Artificial Sequence: Synthetic light chain variable region CDR L1"
TGGSSNIGAGYDVH

SEQ ID NO: 1660 - DNA, 42 bp, Artificial Sequence
  source: /note="Description of Artificial Sequence: Synthetic light chain variable region CDR L1"
actgggggcagctccaacatcggggcaggttatgatgtgcac

SEQ ID NO: 1661 - protein, 7 aa, Artificial Sequence
  source: /note="Description of Artificial Sequence: Synthetic light chain variable region CDR L2"
GNSNRPS

SEQ ID NO: 1662 - DNA, 21 bp, Artificial Sequence
  source: /note="Description of Artificial Sequence: Synthetic light chain variable region CDR L2"
ggtaacagcaatcggccctca

SEQ ID NO: 1663 - protein, 10 aa, Artificial Sequence
  source: /note="Description of Artificial Sequence: Synthetic light chain variable region CDR L3"
QSYDSRLSVV

SEQ ID NO: 1664 - DNA, 30 bp, Artificial Sequence
  source: /note="Description of Artificial Sequence: Synthetic light chain variable region CDR L3"
cagtcctatgacagccgcctgagtgtggta

SEQ ID NO: 1665 - DNA, 366 bp, Artificial Sequence
  source: /note="Description of Artificial Sequence: Synthetic heavy chain variable region"
gaggtgcagctggtggagtctggggctgaggtgaagaagcctgggtcctcggtgaaggtctcctgcaaggcttctggaggcaccttcagcagctatgctatcagctgggtgcgacaggcccctggacaaggacttgagtggatgggagggaccatccctatttttggtacaatcaactacgcacagaagttccagggcagactcacgattaacgcggacgcatcaacgagcacagcctacatggagctgagcagcctgagatctgaggacacggccgtgtatttctgtgcgagagaccggactacagctgtgaggtactacgctatggacgtctggggccaagggaccacggtcaccgtctcttca

SEQ ID NO: 1666 - protein, 122 aa, Artificial Sequence
  source: /note="Description of Artificial Sequence: Synthetic heavy chain variable region"
EVQLVESGAEVKKPGSSVKVSCKASGGTFSSYAISWVRQAPGQGLEWMGGTIPIFGTINYAQKFQGRLTINADASTSTAYMELSSLRSEDTAVYFCARDRTTAVRYYAMDVWGQGTTVTVSS

SEQ ID NO: 1667 - protein, 9 aa, Artificial Sequence
  source: /note="Description of Artificial Sequence: Synthetic heavy chain variable region CDR H1"
GTFSSYAIS

SEQ ID NO: 1668 - DNA, 27 bp, Artificial Sequence
  source: /note="Description of Artificial Sequence: Synthetic heavy chain variable region CDR H1"
ggcaccttcagcagctatgctatcagc

SEQ ID NO: 1669 - protein, 17 aa, Artificial Sequence
  source: /note="Description of Artificial Sequence: Synthetic heavy chain variable region CDR H2"
GTIPIFGTINYAQKFQG

SEQ ID NO: 1670 - DNA, 51 bp, Artificial Sequence
  source: /note="Description of Artificial Sequence: Synthetic heavy chain variable region CDR H2"
gggaccatccctatttttggtacaatcaactacgcacagaagttccagggc

SEQ ID NO: 1671 - protein, 15 aa, Artificial Sequence
  source: /note="Description of Artificial Sequence: Synthetic heavy chain variable region CDR H3"
ARDRTTAVRYYAMDV

SEQ ID NO: 1672 - DNA, 45 bp, Artificial Sequence
  source: /note="Description of Artificial Sequence: Synthetic heavy chain variable region CDR H3"
gcgagagaccggactacagctgtgaggtactacgctatggacgtc

SEQ ID NO: 1673 - DNA, 324 bp, Artificial Sequence
  source: /note="Description of Artificial Sequence: Synthetic light chain variable region"
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatacatccaacagggccactgacatcccagccaggttcagtggcagtgggtctgggacagacttcactctcaccatcagcagcctagagcctgaagattttgcagtttattactgtcagcaccgtgccaactggcccccgctcactttcggcggagggaccaaggtggaaatcaaa

SEQ ID NO: 1674 - protein, 108 aa, Artificial Sequence
  source: /note="Description of Artificial Sequence: Synthetic light chain variable region"
EIVLTQSPATLSLSPGERATLSCRASQSVSSYLAWYQQKPGQAPRLLIYDTSNRATDIPARFSGSGSGTDFTLTISSLEPEDFAVYYCQHRANWPPLTFGGGTKVEIK

SEQ ID NO: 1675 - protein, 11 aa, Artificial Sequence
  source: /note="Description of Artificial Sequence: Synthetic light chain variable region CDR L1"
RASQSVSSYLA

SEQ ID NO: 1676 - DNA, 33 bp, Artificial Sequence; identical to SEQ ID NO: 1212
  source: /note="Description of Artificial Sequence: Synthetic light chain variable region CDR L1"

SEQ ID NO: 1677 - protein, 7 aa, Artificial Sequence
  source: /note="Description of Artificial Sequence: Synthetic light chain variable region CDR L2"
DTSNRAT

SEQ ID NO: 1678 - DNA, 21 bp, Artificial Sequence
  source: /note="Description of Artificial Sequence: Synthetic light chain variable region CDR L2"
gatacatccaacagggccact

SEQ ID NO: 1679 - protein, 10 aa, Artificial Sequence
  source: /note="Description of Artificial Sequence: Synthetic light chain variable region CDR L3"
QHRANWPPLT

SEQ ID NO: 1680 - DNA, 30 bp, Artificial Sequence
  source: /note="Description of Artificial Sequence: Synthetic light chain variable region CDR L3"
cagcaccgtgccaactggcccccgctcact

SEQ ID NO: 1681 - DNA, 378 bp, Artificial Sequence
  source: /note="Description of Artificial Sequence: Synthetic heavy chain variable region"
caggtccagcttgtgcagtctgggcctgaggtgaagaggcctgggtcctcggtgaaggtctcctgcaaggcttctggagacaccttcaacaactacgccatcagctgggtgcgacaggcccctggacaaggacttgagtggatgggagggatccaccctaccactgctacaccaaactacgcacagaagttccagggcagagtcgtcattagcgcggacaagtccacgagtacagcctacttggacctgagtcggctgagatctgaggacacggccatgtattactgtgcgagagttggtgtgggacgcacttgggtctatgatattatgggttacctagactactggggccagggaaccctggtcaccgtctcctca

SEQ ID NO: 1682 - protein, 126 aa, Artificial Sequence
  source: /note="Description of Artificial Sequence: Synthetic heavy chain variable region"
QVQLVQSGPEVKRPGSSVKVSCKASGDTFNNYAISWVRQAPGQGLEWMGGIHPTTATPNYAQKFQGRVVISADKSTSTAYLDLSRLRSEDTAMYYCARVGVGRTWVYDIMGYLDYWGQGTLVTVSS

SEQ ID NO: 1683 - protein, 9 aa, Artificial Sequence
  source: /note="Description of Artificial Sequence: Synthetic heavy chain variable region CDR H1"
DTFNNYAIS

SEQ ID NO: 1684 - DNA, 27 bp, Artificial Sequence
  source: /note="Description of Artificial Sequence: Synthetic heavy chain variable region CDR H1"
gacaccttcaacaactacgccatcagc

SEQ ID NO: 1685 - protein, 17 aa, Artificial Sequence
  source: /note="Description of Artificial Sequence: Synthetic heavy chain variable region CDR H2"
GIHPTTATPNYAQKFQG

SEQ ID NO: 1686 - DNA, 51 bp, Artificial Sequence
  source: /note="Description of Artificial Sequence: Synthetic heavy chain variable region CDR H2"
gggatccaccctaccactgctacaccaaactacgcacagaagttccagggc

SEQ ID NO: 1687 - protein, 19 aa, Artificial Sequence
  source: /note="Description of Artificial Sequence: Synthetic heavy chain variable region CDR H3"
ARVGVGRTWVYDIMGYLDY

SEQ ID NO: 1688 - DNA, 57 bp, Artificial Sequence
  source: /note="Description of Artificial Sequence: Synthetic heavy chain variable region CDR H3"
gcgagagttggtgtgggacgcacttgggtctatgatattatgggttacctagactac

SEQ ID NO: 1689 - DNA, 324 bp, Artificial Sequence
  source: /note="Description of Artificial Sequence: Synthetic light chain variable region"
gaaattgtattgacacagtctccagccaccctgtctttgtctccaggggaaagagccaccctctcctgcagggccagtcagagtgttagcgactacttggcctggtaccaacaaagacctggccaggctcccaggctcctcatctatgatgcgtccaccagggccactggcatcccagacaggttcagtggcggtgggtctgggacagacttcactctcaccatcagcagcctagagcctgaagattttgcagtttattactgtcaacaccgtaacaactggccttccctcactttcggcggagggaccaaggtggaaatcaaa

SEQ ID NO: 1690 - protein, 108 aa, Artificial Sequence
  source: /note="Description of Artificial Sequence: Synthetic light chain variable region"
EIVLTQSPATLSLSPGERATLSCRASQSVSDYLAWYQQRPGQAPRLLIYDASTRATGIPDRFSGGGSGTDFTLTISSLEPEDFAVYYCQHRNNWPSLTFGGGTKVEIK

SEQ ID NO: 1691 - protein, 11 aa, Artificial Sequence
  source: /note="Description of Artificial Sequence: Synthetic light chain variable region CDR L1"
RASQSVSDYLA

SEQ ID NO: 1692 - DNA, 33 bp, Artificial Sequence
  source: /note="Description of Artificial Sequence: Synthetic light chain variable region CDR L1"
agggccagtcagagtgttagcgactacttggcc

SEQ ID NO: 1693 - protein, 7 aa, Artificial Sequence
  source: /note="Description of Artificial Sequence: Synthetic light chain variable region CDR L2"
DASTRAT

SEQ ID NO: 1694 - DNA, 21 bp, Artificial Sequence
  source: /note="Description of Artificial Sequence: Synthetic light chain variable region CDR L2"
gatgcgtccaccagggccact

SEQ ID NO: 1695 - protein, 10 aa, Artificial Sequence
  source: /note="Description of Artificial Sequence: Synthetic light chain variable region CDR L3"
QHRNNWPSLT

SEQ ID NO: 1696 - DNA, 30 bp, Artificial Sequence
  source: /note="Description of Artificial Sequence: Synthetic light chain variable region CDR L3"
caacaccgtaacaactggccttccctcact

SEQ ID NO: 1697 - DNA, 381 bp, Artificial Sequence
  source: /note="Description of Artificial Sequence: Synthetic heavy chain variable region"
caggtgcagctacagcagtggggcgcaggactgctgaagccttcggagaccctgtccctcacctgcggtgtctctgatgggtccttcagtgcctactactggaactggatccgccagtccccagggaaggggctggagtggattggggaaaccaatccaagtgaaaacaccaactacagcccgtccctcaagaatcgagtcaccatatcggcagacaggtccgcgaatcagttctccctgagactgaggtctgtgaccgccgcggacacgggtgtttattactgtgcgagaggccgcggttattatggttcgacgactgattatcgggggctccactggttcgacccctggggccagggaaccctggtcaccgtctcctca

SEQ ID NO: 1698 - protein, 127 aa, Artificial Sequence
  source: /note="Description of Artificial Sequence: Synthetic heavy chain variable region"
QVQLQQWGAGLLKPSETLSLTCGVSDGSFSAYYWNWIRQSPGKGLEWIGETNPSENTNYSPSLKNRVTISADRSANQFSLRLRSVTAADTGVYYCARGRGYYGSTTDYRGLHWFDPWGQGTLVTVSS

SEQ ID NO: 1699 - protein, 9 aa, Artificial Sequence
  source: /note="Description of Artificial Sequence: Synthetic heavy chain variable region CDR H1"
GSFSAYYWN

SEQ ID NO: 1700 - DNA, 27 bp, Artificial Sequence
  source: /note="Description of Artificial Sequence: Synthetic heavy chain variable region CDR H1"
gggtccttcagtgcctactactggaac

SEQ ID NO: 1701 - protein, 16 aa, Artificial Sequence
  source: /note="Description of Artificial Sequence: Synthetic heavy chain variable region CDR H2"
ETNPSENTNYSPSLKN

SEQ ID NO: 1702 - DNA, 48 bp, Artificial Sequence
  source: /note="Description of Artificial Sequence: Synthetic heavy chain variable region CDR H2"
gaaaccaatccaagtgaaaacaccaactacagcccgtccctcaagaat

SEQ ID NO: 1703 - protein, 21 aa, Artificial Sequence
  source: /note="Description of Artificial Sequence: Synthetic heavy chain variable region CDR H3"
ARGRGYYGSTTDYRGLHWFDP

SEQ ID NO: 1704 - DNA, 63 bp, Artificial Sequence
  source: /note="Description of Artificial Sequence: Synthetic heavy chain variable region CDR H3"
gcgagaggccgcggttattatggttcgacgactgattatcgggggctccactggttcgacccc

SEQ ID NO: 1705 - DNA, 321 bp, Artificial Sequence
  source: /note="Description of Artificial Sequence: Synthetic light chain variable region"
gaaacgacactcacgcagtctccagtcaccctgtctgtgtctccaggggaaagagccaccctctcctgcagggccagtcagagtgttagcttcaacttagcctggtaccagcagaaacctggccaggctcccaggctcctcatctatggtgcatccaccagggtcactaatctcccactcaggttcagtggcagtgggtctgggacagagttcactctcaccatcagcagcctgcagtctgaagattttgcagtttattactgtcagcagtataataactggcctcggacttttggccaggggaccaagctggagatcaaa

SEQ ID NO: 1706 - protein, 107 aa, Artificial Sequence
  source: /note="Description of Artificial Sequence: Synthetic light chain variable region"
ETTLTQSPVTLSVSPGERATLSCRASQSVSFNLAWYQQKPGQAPRLLIYGASTRVTNLPLRFSGSGSGTEFTLTISSLQSEDFAVYYCQQYNNWPRTFGQGTKLEIK

SEQ ID NO: 1707 - protein, 11 aa, Artificial Sequence
  source: /note="Description of Artificial Sequence: Synthetic light chain variable region CDR L1"
RASQSVSFNLA

SEQ ID NO: 1708 - DNA, 33 bp, Artificial Sequence
  source: /note="Description of Artificial Sequence: Synthetic light chain variable region CDR L1"
agggccagtcagagtgttagcttcaacttagcc

SEQ ID NO: 1709 - protein, 7 aa, Artificial Sequence
  source: /note="Description of Artificial Sequence: Synthetic light chain variable region CDR L2"
GASTRVT

SEQ ID NO: 1710 - DNA, 21 bp, Artificial Sequence
  source: /note="Description of Artificial Sequence: Synthetic light chain variable region CDR L2"
ggtgcatccaccagggtcact

SEQ ID NO: 1711 - protein, 9 aa, Artificial Sequence
  source: /note="Description of Artificial Sequence: Synthetic light chain variable region CDR L3"
QQYNNWPRT

SEQ ID NO: 1712 - DNA, 27 bp, Artificial Sequence
  source: /note="Description of Artificial Sequence: Synthetic light chain variable region CDR L3"
cagcagtataataactggcctcggact

SEQ ID NO: 1713 - DNA, 378 bp, Artificial Sequence
  source: /note="Description of Artificial Sequence: Synthetic heavy chain variable region"
gaggtgcagctggtggagtctgggggaggcttggttcagccgggggggtccctgagactctcctgtgcagcctctggattcactttcagcgacttttccatgagctgggtccgccaggctccagggaaggggctggaatgggtctcacttattaaaagtagcggttatgcatactatgcagactccgtgaggggccggttcaccatctccagagacaattccaagaacaccctgtatctgcaaatgaacagcctgagagccgaggacacggccatatattattgtgcgaaagacgccgatttttggagtggtgccgcctacaatggaggatacaactttgactcctggggccagggaaccctggtcaccgtctcctca

SEQ ID NO: 1714 - protein, 126 aa, Artificial Sequence
  source: /note="Description of Artificial Sequence: Synthetic heavy chain variable region"
EVQLVESGGGLVQPGGSLRLSCAASGFTFSDFSMSWVRQAPGKGLEWVSLIKSSGYAYYADSVRGRFTISRDNSKNTLYLQMNSLRAEDTAIYYCAKDADFWSGAAYNGGYNFDSWGQGTLVTVSS

SEQ ID NO: 1715 - protein, 9 aa, Artificial Sequence
  source: /note="Description of Artificial Sequence: Synthetic heavy chain variable region CDR H1"
FTFSDFSMS

SEQ ID NO: 1716 - DNA, 27 bp, Artificial Sequence
  source: /note="Description of Artificial Sequence: Synthetic heavy chain variable region CDR H1"
ttcactttcagcgacttttccatgagc

SEQ ID NO: 1717 - protein, 16 aa, Artificial Sequence
  source: /note="Description of Artificial Sequence: Synthetic heavy chain variable region CDR H2"
LIKSSGYAYYADSVRG

SEQ ID NO: 1718 - DNA, 48 bp, Artificial Sequence
  source: /note="Description of Artificial Sequence: Synthetic heavy chain variable region CDR H2"
cttattaaaagtagcggttatgcatactatgcagactccgtgaggggc

SEQ ID NO: 1719 - protein, 20 aa, Artificial Sequence
  source: /note="Description of Artificial Sequence: Synthetic heavy chain variable region CDR H3"
AKDADFWSGAAYNGGYNFDS

SEQ ID NO: 1720 - DNA, 60 bp, Artificial Sequence
  source: /note="Description of Artificial Sequence: Synthetic heavy chain variable region CDR H3"
gcgaaagacgccgatttttggagtggtgccgcctacaatggaggatacaactttgactcc

SEQ ID NO: 1721 - DNA, 324 bp, Artificial Sequence
  source: /note="Description of Artificial Sequence: Synthetic light chain variable region"
gacatccagatgacccagtctccagccaccctgtctgtatttccaggggacagagccaccctctcctgcagggccagtcagagtgttggcagcaacttggcctggtaccagcagaaacctggccaggctcccaggctcctcatctttggtgcctcaaccagggccactggtatcccagccaggttcagtggcagtgggtctgggacagagttcactctcaccatcagcagcctgcagtctgaagattttgcagtttattactgtcagcagtatcataactggcctccgctcactttcggcggagggaccaaagtggatatcaaa

SEQ ID NO: 1722 - protein, 108 aa, Artificial Sequence
  source: /note="Description of Artificial Sequence: Synthetic light chain variable region"
DIQMTQSPATLSVFPGDRATLSCRASQSVGSNLAWYQQKPGQAPRLLIFGASTRATGIPARFSGSGSGTEFTLTISSLQSEDFAVYYCQQYHNWPPLTFGGGTKVDIK

SEQ ID NO: 1723 - protein, 11 aa, Artificial Sequence
  source: /note="Description of Artificial Sequence: Synthetic light chain variable region CDR L1"
RASQSVGSNLA

SEQ ID NO: 1724 - DNA, 33 bp, Artificial Sequence
  source: /note="Description of Artificial Sequence: Synthetic light chain variable region CDR L1"
agggccagtcagagtgttggcagcaacttggcc

SEQ ID NO: 1725 - protein, 7 aa, Artificial Sequence
  source: /note="Description of Artificial Sequence: Synthetic light chain variable region CDR L2"
GASTRAT

SEQ ID NO: 1726 - DNA, 21 bp, Artificial Sequence
  source: /note="Description of Artificial Sequence: Synthetic light chain variable region CDR L2"
ggtgcctcaaccagggccact

SEQ ID NO: 1727 - protein, 10 aa, Artificial Sequence
  source: /note="Description of Artificial Sequence: Synthetic light chain variable region CDR L3"
QQYHNWPPLT

SEQ ID NO: 1728 - DNA, 30 bp, Artificial Sequence
  source: /note="Description of Artificial Sequence: Synthetic light chain variable region CDR L3"
cagcagtatcataactggcctccgctcact

SEQ ID NO: 1729 - DNA, 375 bp, Artificial Sequence
  source: /note="Description of Artificial Sequence: Synthetic Heavy chain variable region ('HC') nucleic acid sequence"
caggtccagcttgtacagtctggggctgaagtgaagaggcctgggtcctcggtgaaggtctcctgcaaggcttctggaggcaccttcagcagctttgggatcaactgggtgcgacaggcccctggacaagggcttgagtggatgggagggctcaatcctatctttggtacaccatctaacgcacagaagttccagggcagagtcacgattaccgcggacgaatccacgagcacagcctacatggagctgagcagcctgagatctgaggacacggccgtctattactgtgcctcattacgatattttgactggcaacctggggggtcctactggttcgacccctggggccagggaaccctggtcaccgtctcctca

SEQ ID NO: 1730 - protein, 125 aa, Artificial Sequence
  source: /note="Description of Artificial Sequence: Synthetic Heavy chain variable region ('HC') amino acid sequence"
QVQLVQSGAEVKRPGSSVKVSCKASGGTFSSFGINWVRQAPGQGLEWMGGLNPIFGTPSNAQKFQGRVTITADESTSTAYMELSSLRSEDTAVYYCASLRYFDWQPGGSYWFDPWGQGTLVTVSS

SEQ ID NO: 1731 - protein, 9 aa, Artificial Sequence
  source: /note="Description of Artificial Sequence: Synthetic Heavy chain variable region CDR H1 ('H1') amino acid sequence"
GTFSSFGIN

SEQ ID NO: 1732 - protein, 17 aa, Artificial Sequence
  source: /note="Description of Artificial Sequence: Synthetic Heavy chain variable region CDR H2 ('H2') amino acid sequence"
GLNPIFGTPSNAQKFQG

SEQ ID NO: 1733 - protein, 18 aa, Artificial Sequence
  source: /note="Description of Artificial Sequence: Synthetic Heavy chain variable region CDR H3 ('H3') amino acid sequence"
ASLRYFDWQPGGSYWFDP

SEQ ID NO: 1734 - DNA, 330 bp, Artificial Sequence
  source: /note="Description of Artificial Sequence: Synthetic Light chain variable region('LC') nucleic acid sequence"
cagcctgggctgactcagccaccctcagtgtcagtggccccaggaaagacggccaggattgcctgtgggggagacaacattggaactaaaggagtgcactggtaccagcagaagccaggccaggcccctgtgctggtcatctattatgatagcgaccggccctcagggatccctgagcgattctctggttccaactctgggaacacggccaccctgaccatcagcggggtcgaagccggggatgaggccgactactactgtcaggtttgggatactattgatgattataaggatggactattcggcggagggaccaagctcaccgtccta

SEQ ID NO: 1735 - protein, 110 aa, Artificial Sequence
  source: /note="Description of Artificial Sequence: Synthetic Light chain variable region ('LC') amino acid sequence"
QPGLTQPPSVSVAPGKTARIACGGDNIGTKGVHWYQQKPGQAPVLVIYYDSDRPSGIPERFSGSNSGNTATLTISGVEAGDEADYYCQVWDTIDDYKDGLFGGGTKLTVL

SEQ ID NO: 1736 - protein, 11 aa, Artificial Sequence
  source: /note="Description of Artificial Sequence: Synthetic Light chain variable region CDR L1 ('L1') amino acid sequence"
GGDNIGTKGVH

SEQ ID NO: 1737 - protein, 7 aa, Artificial Sequence
  source: /note="Description of Artificial Sequence: Synthetic Light chain variable region CDR L2 ('L2') amino acid sequence"
YDSDRPS

SEQ ID NO: 1738 - protein, 13 aa, Artificial Sequence
  source: /note="Description of Artificial Sequence: Synthetic Light chain variable region CDR L3 ('L3') amino acid sequence"
QVWDTIDDYKDGL

SEQ ID NO: 1739 - DNA, 375 bp, Artificial Sequence
  source: /note="Description of Artificial Sequence: Synthetic Heavy chain variable region ('HC') nucleic acid sequence"
caggtccagcttgtacagtctggggctgaagtgaagaggcctgggtcctcggtgaaggtctcctgcaaggcttctggaggcaccttcagcagctttgctatccagtgggtgcgacaggcccctggacaagggcttgagtggatgggagggctcatccctatctttggtacaccagagaacgcacagaagttccagggcagagtcacgattaccgcggacgaatccacgagcacagcctacatggagctgagcagcctgagatctgaggacacggccgtctattactgtgcctcattacgatattttgactggcaacctggggggtcctactggttcgacccctggggccagggaaccctggtcaccgtctcctca

SEQ ID NO: 1740 - protein, 125 aa, Artificial Sequence
  source: /note="Description of Artificial Sequence: Synthetic Heavy chain variable region ('HC') amino acid sequence"
QVQLVQSGAEVKRPGSSVKVSCKASGGTFSSFAIQWVRQAPGQGLEWMGGLIPIFGTPENAQKFQGRVTITADESTSTAYMELSSLRSEDTAVYYCASLRYFDWQPGGSYWFDPWGQGTLVTVSS

SEQ ID NO: 1741 - protein, 9 aa, Artificial Sequence
  source: /note="Description of Artificial Sequence: Synthetic Heavy chain variable region CDR H1 ('H1') amino acid sequence"
GTFSSFAIQ

SEQ ID NO: 1742 - protein, 17 aa, Artificial Sequence
  source: /note="Description of Artificial Sequence: Synthetic Heavy chain variable region CDR H2 ('H2') amino acid sequence"
GLIPIFGTPENAQKFQG

SEQ ID NO: 1743 - protein, 18 aa, Artificial Sequence
  source: /note="Description of Artificial Sequence: Synthetic Heavy chain variable region CDR H3 ('H3') amino acid sequence"
ASLRYFDWQPGGSYWFDP

SEQ ID NO: 1744 - DNA, 330 bp, Artificial Sequence; identical to SEQ ID NO: 73
  source: /note="Description of Artificial Sequence: Synthetic Light chain variable region('LC') nucleic acid sequence"

SEQ ID NO: 1745 - protein, 110 aa, Artificial Sequence; identical to SEQ ID NO: 74
  source: /note="Description of Artificial Sequence: Synthetic Light chain variable region ('LC') amino acid sequence"

SEQ ID NO: 1746 - protein, 11 aa, Artificial Sequence
  source: /note="Description of Artificial Sequence: Synthetic Light chain variable region CDR L1 ('L1') amino acid sequence"
GGDNIGTKGVH

SEQ ID NO: 1747 - protein, 7 aa, Artificial Sequence
  source: /note="Description of Artificial Sequence: Synthetic Light chain variable region CDR L2 ('L2') amino acid sequence"
YDSDRPS

SEQ ID NO: 1748 - protein, 13 aa, Artificial Sequence
  source: /note="Description of Artificial Sequence: Synthetic Light chain variable region CDR L3 ('L3') amino acid sequence"
QVWDTIDDHKDGL

SEQ ID NO: 1749 - DNA, 372 bp, Artificial Sequence; identical to SEQ ID NO: 1473
  source: /note="Description of Artificial Sequence: Synthetic Heavy chain variable region ('HC') nucleic acid sequence"

SEQ ID NO: 1750 - protein, 124 aa, Artificial Sequence; identical to SEQ ID NO: 1474
  source: /note="Description of Artificial Sequence: Synthetic Heavy chain variable region ('HC') amino acid sequence"

SEQ ID NO: 1751 - protein, 9 aa, Artificial Sequence
  source: /note="Description of Artificial Sequence: Synthetic Heavy chain variable region CDR H1 ('H1') amino acid sequence"
FTFSDFSMH

SEQ ID NO: 1752 - protein, 17 aa, Artificial Sequence
  source: /note="Description of Artificial Sequence: Synthetic Heavy chain variable region CDR H2 ('H2') amino acid sequence"
LISNDGSNKYYSDSLKG

SEQ ID NO: 1753 - protein, 17 aa, Artificial Sequence
  source: /note="Description of Artificial Sequence: Synthetic Heavy chain variable region CDR H3 ('H3') amino acid sequence"
ARDAVPHYDYVWGNFDY

SEQ ID NO: 1754 - DNA, 372 bp, Artificial Sequence; identical to SEQ ID NO: 1473
  source: /note="Description of Artificial Sequence: Synthetic Light chain variable region('LC') nucleic acid sequence"

SEQ ID NO: 1755 - protein, 124 aa, Artificial Sequence; identical to SEQ ID NO: 1474
  source: /note="Description of Artificial Sequence: Synthetic Light chain variable region ('LC') amino acid sequence"

SEQ ID NO: 1756 - protein, 14 aa, Artificial Sequence
  source: /note="Description of Artificial Sequence: Synthetic Light chain variable region CDR L1 ('L1') amino acid sequence"
TGTASDVGGYNYVS

SEQ ID NO: 1757 - protein, 7 aa, Artificial Sequence
  source: /note="Description of Artificial Sequence: Synthetic Light chain variable region CDR L2 ('L2') amino acid sequence"
EVSNRPS

SEQ ID NO: 1758 - protein, 10 aa, Artificial Sequence
  source: /note="Description of Artificial Sequence: Synthetic Light chain variable region CDR L3 ('L3') amino acid sequence"
SSYTSFTPVV

SEQ ID NO: 1759 - DNA, 372 bp, Artificial Sequence; identical to SEQ ID NO: 1473
  source: /note="Description of Artificial Sequence: Synthetic Heavy chain variable region ('HC') nucleic acid sequence"

SEQ ID NO: 1760 - protein, 124 aa, Artificial Sequence; identical to SEQ ID NO: 1474
  source: /note="Description of Artificial Sequence: Synthetic Heavy chain variable region ('HC') amino acid sequence"

SEQ ID NO: 1761 - protein, 9 aa, Artificial Sequence
  source: /note="Description of Artificial Sequence: Synthetic Heavy chain variable region CDR H1 ('H1') amino acid sequence"
FTFSDFSMH

SEQ ID NO: 1762 - protein, 17 aa, Artificial Sequence
  source: /note="Description of Artificial Sequence: Synthetic Heavy chain variable region CDR H2 ('H2') amino acid sequence"
LISNDGSNKYYSDSLKG

SEQ ID NO: 1763 - protein, 17 aa, Artificial Sequence
  source: /note="Description of Artificial Sequence: Synthetic Heavy chain variable region CDR H3 ('H3') amino acid sequence"
ARDAVPHYDYVWGNFDY

SEQ ID NO: 1764 - DNA, 330 bp, Artificial Sequence
  source: /note="Description of Artificial Sequence: Synthetic Light chain variable region('LC') nucleic acid sequence"
cagtctgttctgactcagcctgcctccgtgtctgcgtctcctggacagtcgatcaccatctcctgcactggaaccgcgagtgacgttggtggttataattatgtctcctggtaccaacagcacccaggcaaagcccccaaactcataatttatgaggtcagtaatcggccctcaggggtttctaatcgcttctctggctccaagtctggcaacacggcctccctgaccatctctgggctccaggctgacgacgaggctgattattactgcagctcatatacagctttcactcccgtggtattcggcggagggaccaagctgaccgtccta

SEQ ID NO: 1765 - protein, 110 aa, Artificial Sequence
  source: /note="Description of Artificial Sequence: Synthetic Light chain variable region ('LC') amino acid sequence"
QSVLTQPASVSASPGQSITISCTGTASDVGGYNYVSWYQQHPGKAPKLIIYEVSNRPSGVSNRFSGSKSGNTASLTISGLQADDEADYYCSSYTAFTPVVFGGGTKLTVL

SEQ ID NO: 1766 - protein, 14 aa, Artificial Sequence
  source: /note="Description of Artificial Sequence: Synthetic Light chain variable region CDR L1 ('L1') amino acid sequence"
TGTASDVGGYNYVS

SEQ ID NO: 1767 - protein, 7 aa, Artificial Sequence
  source: /note="Description of Artificial Sequence: Synthetic Light chain variable region CDR L2 ('L2') amino acid sequence"
EVSNRPS

SEQ ID NO: 1768 - protein, 10 aa, Artificial Sequence
  source: /note="Description of Artificial Sequence: Synthetic Light chain variable region CDR L3 ('L3') amino acid sequence"
SSYTAFTPVV

SEQ ID NO: 1769 - DNA, 372 bp, Artificial Sequence; identical to SEQ ID NO: 1473
  source: /note="Description of Artificial Sequence: Synthetic Heavy chain variable region ('HC') nucleic acid sequence"

SEQ ID NO: 1770 - protein, 124 aa, Artificial Sequence; identical to SEQ ID NO: 1474
  source: /note="Description of Artificial Sequence: Synthetic Heavy chain variable region ('HC') amino acid sequence"

SEQ ID NO: 1771 - protein, 9 aa, Artificial Sequence
  source: /note="Description of Artificial Sequence: Synthetic Heavy chain variable region CDR H1 ('H1') amino acid sequence"
FTFSDFSMH

SEQ ID NO: 1772 - protein, 17 aa, Artificial Sequence
  source: /note="Description of Artificial Sequence: Synthetic Heavy chain variable region CDR H2 ('H2') amino acid sequence"
LISNDGSNKYYSDSLKG

SEQ ID NO: 1773 - protein, 17 aa, Artificial Sequence
  source: /note="Description of Artificial Sequence: Synthetic Heavy chain variable region CDR H3 ('H3') amino acid sequence"
ARDAVPHYDYVWGNFDY

SEQ ID NO: 1774 - DNA, 330 bp, Artificial Sequence
  source: /note="Description of Artificial Sequence: Synthetic Light chain variable region('LC') nucleic acid sequence"
cagtctgttctgactcagcctgcctccgtgtctgcgtctcctggacagtcgatcaccatctcctgcactggaaccgcgagtgacgttggtggttataattatgtctcctggtaccaacagcacccaggcaaagcccccaaactcataatttatgagaagagtaatcggccctcaggggtttctaatcgcttctctggctccaagtctggcaacacggcctccctgaccatctctgggctccaggctgacgacgaggctgattattactgcagctcatatacaagtttcactcccgtggtattcggcggagggaccaagctgaccgtccta

SEQ ID NO: 1775 - protein, 110 aa, Artificial Sequence
  source: /note="Description of Artificial Sequence: Synthetic Light chain variable region ('LC') amino acid sequence"
QSVLTQPASVSASPGQSITISCTGTASDVGGYNYVSWYQQHPGKAPKLIIYEKSNRPSGVSNRFSGSKSGNTASLTISGLQADDEADYYCSSYTSFTPVVFGGGTKLTVL

SEQ ID NO: 1776 - protein, 14 aa, Artificial Sequence
  source: /note="Description of Artificial Sequence: Synthetic Light chain variable region CDR L1 ('L1') amino acid sequence"
TGTASDVGGYNYVS

SEQ ID NO: 1777 - protein, 7 aa, Artificial Sequence
  source: /note="Description of Artificial Sequence: Synthetic Light chain variable region CDR L2 ('L2') amino acid sequence"
EKSNRPS

SEQ ID NO: 1778 - protein, 10 aa, Artificial Sequence
  source: /note="Description of Artificial Sequence: Synthetic Light chain variable region CDR L3 ('L3') amino acid sequence"
SSYTSFTPVV

SEQ ID NO: 1779 - DNA, 366 bp, Artificial Sequence; identical to SEQ ID NO: 1649
  source: /note="Description of Artificial Sequence: Synthetic Heavy chain variable region ('HC') nucleic acid sequence"

SEQ ID NO: 1780 - protein, 122 aa, Artificial Sequence; identical to SEQ ID NO: 1650
  source: /note="Description of Artificial Sequence: Synthetic Heavy chain variable region ('HC') amino acid sequence"

SEQ ID NO: 1781 - protein, 9 aa, Artificial Sequence
  source: /note="Description of Artificial Sequence: Synthetic Heavy chain variable region CDR H1 ('H1') amino acid sequence"
FTFSSYTMN

SEQ ID NO: 1782 - protein, 17 aa, Artificial Sequence
  source: /note="Description of Artificial Sequence: Synthetic Heavy chain variable region CDR H2 ('H2') amino acid sequence"
SITGGSSFTNYADSLEG

SEQ ID NO: 1783 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1784 - DNA, 330 bp, Artificial Sequence
  source: /note="Description of Artificial Sequence: Synthetic Light chain variable region('LC') nucleic acid sequence"
cagtctgtcttgacgcagccgccctcagtgtctggggccccagggcagagggtcaccatctcctgcactgggggcagctccaacatcggggcaggttatgatgtgcactggtaccagcagcttccaggaacagcccctaaactcctcatctatggtaacagcaatcgggggtcaggggtccctgaccgattctctggctccaagtctggcacctcagcctccctggccatcactgggctccaggctgaggatgaggctgattattactgccagtcctatgacagccgcctgcaggtggtattcggcggagggaccaaggtgaccgtccta

SEQ ID NO: 1785 - protein, 110 aa, Artificial Sequence
  source: /note="Description of Artificial Sequence: Synthetic Light chain variable region ('LC') amino acid sequence"
QSVLTQPPSVSGAPGQRVTISCTGGSSNIGAGYDVHWYQQLPGTAPKLLIYGNSNRGSGVPDRFSGSKSGTSASLAITGLQAEDEADYYCQSYDSRLQVVFGGGTKVTVL

SEQ ID NO: 1786 - protein, 14 aa, Artificial Sequence
  source: /note="Description of Artificial Sequence: Synthetic Light chain variable region CDR L1 ('L1') amino acid sequence"
TGGSSNIGAGYDVH

SEQ ID NO: 1787 - protein, 7 aa, Artificial Sequence
  source: /note="Description of Artificial Sequence: Synthetic Light chain variable region CDR L2 ('L2') amino acid sequence"
GNSNRGS

SEQ ID NO: 1788 - protein, 10 aa, Artificial Sequence
  source: /note="Description of Artificial Sequence: Synthetic Light chain variable region CDR L3 ('L3') amino acid sequence"
QSYDSRLQVV

SEQ ID NO: 1789 - DNA, 366 bp, Artificial Sequence; identical to SEQ ID NO: 1649
  source: /note="Description of Artificial Sequence: Synthetic Heavy chain variable region ('HC') nucleic acid sequence"

SEQ ID NO: 1790 - protein, 122 aa, Artificial Sequence; identical to SEQ ID NO: 1650
  source: /note="Description of Artificial Sequence: Synthetic Heavy chain variable region ('HC') amino acid sequence"

SEQ ID NO: 1791 - protein, 9 aa, Artificial Sequence
  source: /note="Description of Artificial Sequence: Synthetic Heavy chain variable region CDR H1 ('H1') amino acid sequence"
FTFSSYTMN

SEQ ID NO: 1792 - protein, 17 aa, Artificial Sequence
  source: /note="Description of Artificial Sequence: Synthetic Heavy chain variable region CDR H2 ('H2') amino acid sequence"
SITGGSSFTNYADSLEG

SEQ ID NO: 1793 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1794 - DNA, 330 bp, Artificial Sequence
  source: /note="Description of Artificial Sequence: Synthetic Light chain variable region('LC') nucleic acid sequence"
cagtctgtcttgacgcagccgccctcagtgtctggggccccagggcagagggtcaccatctcctgcactgggggcagctccaacatcgggaagggttatgatgtgcactggtaccagcagcttccaggaacagcccccaaactcctcatctatggtaacagcaatcggcccgggggggtccctgaccgattctctggctccaagtctggcacctcagcctccctggccatcactgggctccaggctgaggatgaggctgattattactgccagtcctatgacagcgggctgagtgtggtattcggcggagggaccaaggtgaccgtccta

SEQ ID NO: 1795 - protein, 110 aa, Artificial Sequence
  source: /note="Description of Artificial Sequence: Synthetic Light chain variable region ('LC') amino acid sequence"
QSVLTQPPSVSGAPGQRVTISCTGGSSNIGKGYDVHWYQQLPGTAPKLLIYGNSNRPGGVPDRFSGSKSGTSASLAITGLQAEDEADYYCQSYDSGLSVVFGGGTKVTVL

SEQ ID NO: 1796 - protein, 14 aa, Artificial Sequence
  source: /note="Description of Artificial Sequence: Synthetic Light chain variable region CDR L1 ('L1') amino acid sequence"
TGGSSNIGKGYDVH

SEQ ID NO: 1797 - protein, 7 aa, Artificial Sequence
  source: /note="Description of Artificial Sequence: Synthetic Light chain variable region CDR L2 ('L2') amino acid sequence"
GNSNRPG

SEQ ID NO: 1798 - protein, 10 aa, Artificial Sequence
  source: /note="Description of Artificial Sequence: Synthetic Light chain variable region CDR L3 ('L3') amino acid sequence"
QSYDSGLSVV

SEQ ID NO: 1799 - DNA, 366 bp, Artificial Sequence
  source: /note="Description of Artificial Sequence: Synthetic Heavy chain variable region ('HC') nucleic acid sequence"
caggtccagctggtacagtctgggggaggcctggtcaagcctggggggtccctgagactctcttgtgcagcctctggattcaagttcagtagctataccatgaactgggtccgccaggctccagggaaggggctggagtgggtctcatccattactggtggtagtagtttcacaaactacgcagactcactggagggccgattcaccatctccagagataacgccaagagctcactttttctgcaaatgaacagcctgagagtcgaggacacggctgtatattactgtgcgagagatcagccggggacgatttttggagtggtccaggactactggggccagggaaccctggtcaccgtctcctca

SEQ ID NO: 1800 - protein, 122 aa, Artificial Sequence
  source: /note="Description of Artificial Sequence: Synthetic Heavy chain variable region ('HC') amino acid sequence"
QVQLVQSGGGLVKPGGSLRLSCAASGFKFSSYTMNWVRQAPGKGLEWVSSITGGSSFTNYADSLEGRFTISRDNAKSSLFLQMNSLRVEDTAVYYCARDQPGTIFGVVQDYWGQGTLVTVSS

SEQ ID NO: 1801 - protein, 9 aa, Artificial Sequence
  source: /note="Description of Artificial Sequence: Synthetic Heavy chain variable region CDR H1 ('H1') amino acid sequence"
FKFSSYTMN

SEQ ID NO: 1802 - protein, 17 aa, Artificial Sequence
  source: /note="Description of Artificial Sequence: Synthetic Heavy chain variable region CDR H2 ('H2') amino acid sequence"
SITGGSSFTNYADSLEG

SEQ ID NO: 1803 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1804 - DNA, 330 bp, Artificial Sequence; identical to SEQ ID NO: 1657
  source: /note="Description of Artificial Sequence: Synthetic Light chain variable region('LC') nucleic acid sequence"

SEQ ID NO: 1805 - protein, 110 aa, Artificial Sequence; identical to SEQ ID NO: 1658
  source: /note="Description of Artificial Sequence: Synthetic Light chain variable region ('LC') amino acid sequence"

SEQ ID NO: 1806 - protein, 14 aa, Artificial Sequence
  source: /note="Description of Artificial Sequence: Synthetic Light chain variable region CDR L1 ('L1') amino acid sequence"
TGGSSNIGAGYDVH

SEQ ID NO: 1807 - protein, 7 aa, Artificial Sequence
  source: /note="Description of Artificial Sequence: Synthetic Light chain variable region CDR L2 ('L2') amino acid sequence"
GNSNRPS

SEQ ID NO: 1808 - protein, 10 aa, Artificial Sequence
  source: /note="Description of Artificial Sequence: Synthetic Light chain variable region CDR L3 ('L3') amino acid sequence"
QSYDSRLSVV

SEQ ID NO: 1809 - DNA, 366 bp, Artificial Sequence
  source: /note="Description of Artificial Sequence: Synthetic Heavy chain variable region ('HC') nucleic acid sequence"
caggtccagctggtacagtctgggggaggcctggtcaagcctggggggtccctgagactctcttgtgcagcctctggattcagcttcagtagctatagcatgaactgggtccgccaggctccagggaaggggctggagtgggtctcatccattactggtggtagtagtttcgttaactacgcagactcactggagggccgattcaccatctccagagataacgccaagagctcactttttctgcaaatgaacagcctgagagtcgaggacacggctgtatattactgtgcgagagatcagccggggacgatttttggagtggtccaggactactggggccagggaaccctggtcaccgtctcctca

SEQ ID NO: 1810 - protein, 122 aa, Artificial Sequence
  source: /note="Description of Artificial Sequence: Synthetic Heavy chain variable region ('HC') amino acid sequence"
QVQLVQSGGGLVKPGGSLRLSCAASGFSFSSYSMNWVRQAPGKGLEWVSSITGGSSFVNYADSLEGRFTISRDNAKSSLFLQMNSLRVEDTAVYYCARDQPGTIFGVVQDYWGQGTLVTVSS

SEQ ID NO: 1811 - protein, 9 aa, Artificial Sequence
  source: /note="Description of Artificial Sequence: Synthetic Heavy chain variable region CDR H1 ('H1') amino acid sequence"
FSFSSYSMN

SEQ ID NO: 1812 - protein, 17 aa, Artificial Sequence
  source: /note="Description of Artificial Sequence: Synthetic Heavy chain variable region CDR H2 ('H2') amino acid sequence"
SITGGSSFVNYADSLEG

SEQ ID NO: 1813 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1814 - DNA, 330 bp, Artificial Sequence; identical to SEQ ID NO: 1657
  source: /note="Description of Artificial Sequence: Synthetic Light chain variable region('LC') nucleic acid sequence"

SEQ ID NO: 1815 - protein, 110 aa, Artificial Sequence; identical to SEQ ID NO: 1658
  source: /note="Description of Artificial Sequence: Synthetic Light chain variable region ('LC') amino acid sequence"

SEQ ID NO: 1816 - protein, 14 aa, Artificial Sequence
  source: /note="Description of Artificial Sequence: Synthetic Light chain variable region CDR L1 ('L1') amino acid sequence"
TGGSSNIGAGYDVH

SEQ ID NO: 1817 - protein, 7 aa, Artificial Sequence
  source: /note="Description of Artificial Sequence: Synthetic Light chain variable region CDR L2 ('L2') amino acid sequence"
GNSNRPS

SEQ ID NO: 1818 - protein, 10 aa, Artificial Sequence
  source: /note="Description of Artificial Sequence: Synthetic Light chain variable region CDR L3 ('L3') amino acid sequence"
QSYDSRLSVV

SEQ ID NO: 1819 - DNA, 366 bp, Artificial Sequence; identical to SEQ ID NO: 1799
  source: /note="Description of Artificial Sequence: Synthetic Heavy chain variable region ('HC') nucleic acid sequence"

SEQ ID NO: 1820 - protein, 122 aa, Artificial Sequence; identical to SEQ ID NO: 1800
  source: /note="Description of Artificial Sequence: Synthetic Heavy chain variable region ('HC') amino acid sequence"

SEQ ID NO: 1821 - protein, 9 aa, Artificial Sequence
  source: /note="Description of Artificial Sequence: Synthetic Heavy chain variable region CDR H1 ('H1') amino acid sequence"
FKFSSYTMN

SEQ ID NO: 1822 - protein, 17 aa, Artificial Sequence
  source: /note="Description of Artificial Sequence: Synthetic Heavy chain variable region CDR H2 ('H2') amino acid sequence"
SITGGSSFTNYADSLEG

SEQ ID NO: 1823 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1824 - DNA, 330 bp, Artificial Sequence; identical to SEQ ID NO: 1784
  source: /note="Description of Artificial Sequence: Synthetic Light chain variable region('LC') nucleic acid sequence"

SEQ ID NO: 1825 - protein, 110 aa, Artificial Sequence; identical to SEQ ID NO: 1785
  source: /note="Description of Artificial Sequence: Synthetic Light chain variable region ('LC') amino acid sequence"

SEQ ID NO: 1826 - protein, 14 aa, Artificial Sequence
  source: /note="Description of Artificial Sequence: Synthetic Light chain variable region CDR L1 ('L1') amino acid sequence"
TGGSSNIGAGYDVH

SEQ ID NO: 1827 - protein, 7 aa, Artificial Sequence
  source: /note="Description of Artificial Sequence: Synthetic Light chain variable region CDR L2 ('L2') amino acid sequence"
GNSNRGS

SEQ ID NO: 1828 - protein, 10 aa, Artificial Sequence
  source: /note="Description of Artificial Sequence: Synthetic Light chain variable region CDR L3 ('L3') amino acid sequence"
QSYDSRLQVV

SEQ ID NO: 1829 - DNA, 366 bp, Artificial Sequence; identical to SEQ ID NO: 1799
  source: /note="Description of Artificial Sequence: Synthetic Heavy chain variable region ('HC') nucleic acid sequence"

SEQ ID NO: 1830 - protein, 122 aa, Artificial Sequence; identical to SEQ ID NO: 1800
  source: /note="Description of Artificial Sequence: Synthetic Heavy chain variable region ('HC') amino acid sequence"

SEQ ID NO: 1831 - protein, 9 aa, Artificial Sequence
  source: /note="Description of Artificial Sequence: Synthetic Heavy chain variable region CDR H1 ('H1') amino acid sequence"
FKFSSYTMN

SEQ ID NO: 1832 - protein, 17 aa, Artificial Sequence
  source: /note="Description of Artificial Sequence: Synthetic Heavy chain variable region CDR H2 ('H2') amino acid sequence"
SITGGSSFTNYADSLEG

SEQ ID NO: 1833 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1834 - DNA, 330 bp, Artificial Sequence; identical to SEQ ID NO: 1794
  source: /note="Description of Artificial Sequence: Synthetic Light chain variable region('LC') nucleic acid sequence"

SEQ ID NO: 1835 - protein, 110 aa, Artificial Sequence; identical to SEQ ID NO: 1795
  source: /note="Description of Artificial Sequence: Synthetic Light chain variable region ('LC') amino acid sequence"

SEQ ID NO: 1836 - protein, 14 aa, Artificial Sequence
  source: /note="Description of Artificial Sequence: Synthetic Light chain variable region CDR L1 ('L1') amino acid sequence"
TGGSSNIGKGYDVH

SEQ ID NO: 1837 - protein, 7 aa, Artificial Sequence
  source: /note="Description of Artificial Sequence: Synthetic Light chain variable region CDR L2 ('L2') amino acid sequence"
GNSNRPG

SEQ ID NO: 1838 - protein, 10 aa, Artificial Sequence
  source: /note="Description of Artificial Sequence: Synthetic Light chain variable region CDR L3 ('L3') amino acid sequence"
QSYDSGLSVV

SEQ ID NO: 1839 - DNA, 366 bp, Artificial Sequence; identical to SEQ ID NO: 1809
  source: /note="Description of Artificial Sequence: Synthetic Heavy chain variable region ('HC') nucleic acid sequence"

SEQ ID NO: 1840 - protein, 122 aa, Artificial Sequence; identical to SEQ ID NO: 1810
  source: /note="Description of Artificial Sequence: Synthetic Heavy chain variable region ('HC') amino acid sequence"

SEQ ID NO: 1841 - protein, 9 aa, Artificial Sequence
  source: /note="Description of Artificial Sequence: Synthetic Heavy chain variable region CDR H1 ('H1') amino acid sequence"
FSFSSYSMN

SEQ ID NO: 1842 - protein, 17 aa, Artificial Sequence
  source: /note="Description of Artificial Sequence: Synthetic Heavy chain variable region CDR H2 ('H2') amino acid sequence"
SITGGSSFVNYADSLEG

SEQ ID NO: 1843 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1844 - DNA, 330 bp, Artificial Sequence
  source: /note="Description of Artificial Sequence: Synthetic Light chain variable region('LC') nucleic acid sequence"
cagtctgtcttgacgcagccgccctcagtgtctggggccccagggcagagggtcaccatctcctgcactgggggcagctccaacatcggggcaggttatgatgtgcactggtaccagcagaatccaggaacagcccctaaactcctcatctatggtaacagcaatcgggggtcaggggtccctgaccgattctctggctccaagtctggcacctcagcctccctggccatcactgggctccaggctgaggatgaggctgattattactgccagtcctatgacagccgcctgcaggtggtattcggcggagggaccaaggtgaccgtccta

SEQ ID NO: 1845 - protein, 110 aa, Artificial Sequence
  source: /note="Description of Artificial Sequence: Synthetic Light chain variable region ('LC') amino acid sequence"
QSVLTQPPSVSGAPGQRVTISCTGGSSNIGAGYDVHWYQQNPGTAPKLLIYGNSNRGSGVPDRFSGSKSGTSASLAITGLQAEDEADYYCQSYDSRLQVVFGGGTKVTVL

SEQ ID NO: 1846 - protein, 14 aa, Artificial Sequence
  source: /note="Description of Artificial Sequence: Synthetic Light chain variable region CDR L1 ('L1') amino acid sequence"
TGGSSNIGAGYDVH

SEQ ID NO: 1847 - protein, 7 aa, Artificial Sequence
  source: /note="Description of Artificial Sequence: Synthetic Light chain variable region CDR L2 ('L2') amino acid sequence"
GNSNRGS

SEQ ID NO: 1848 - protein, 10 aa, Artificial Sequence
  source: /note="Description of Artificial Sequence: Synthetic Light chain variable region CDR L3 ('L3') amino acid sequence"
QSYDSRLQVV

SEQ ID NO: 1849 - DNA, 366 bp, Artificial Sequence; identical to SEQ ID NO: 1809
  source: /note="Description of Artificial Sequence: Synthetic Heavy chain variable region ('HC') nucleic acid sequence"

SEQ ID NO: 1850 - protein, 122 aa, Artificial Sequence; identical to SEQ ID NO: 1810
  source: /note="Description of Artificial Sequence: Synthetic Heavy chain variable region ('HC') amino acid sequence"

SEQ ID NO: 1851 - protein, 9 aa, Artificial Sequence
  source: /note="Description of Artificial Sequence: Synthetic Heavy chain variable region CDR H1 ('H1') amino acid sequence"
FSFSSYSMN

SEQ ID NO: 1852 - protein, 17 aa, Artificial Sequence
  source: /note="Description of Artificial Sequence: Synthetic Heavy chain variable region CDR H2 ('H2') amino acid sequence"
SITGGSSFVNYADSLEG

SEQ ID NO: 1853 - protein, 15 aa, Artificial Sequence
  source: /note="Description of Artificial Sequence: Synthetic Heavy chain variable region CDR H3 ('H3') amino acid sequence"
ARDQPGTIFGVVQDY

SEQ ID NO: 1854 - DNA, 330 bp, Artificial Sequence; identical to SEQ ID NO: 1794
  source: /note="Description of Artificial Sequence: Synthetic Light chain variable region('LC') nucleic acid sequence"

SEQ ID NO: 1855 - protein, 110 aa, Artificial Sequence; identical to SEQ ID NO: 1795
  source: /note="Description of Artificial Sequence: Synthetic Light chain variable region ('LC') amino acid sequence"

SEQ ID NO: 1856 - protein, 14 aa, Artificial Sequence
  source: /note="Description of Artificial Sequence: Synthetic Light chain variable region CDR L1 ('L1') amino acid sequence"
TGGSSNIGKGYDVH

SEQ ID NO: 1857 - protein, 7 aa, Artificial Sequence
  source: /note="Description of Artificial Sequence: Synthetic Light chain variable region CDR L2 ('L2') amino acid sequence"
GNSNRPG

SEQ ID NO: 1858 - protein, 10 aa, Artificial Sequence
  source: /note="Description of Artificial Sequence: Synthetic Light chain variable region CDR L3 ('L3') amino acid sequence"
QSYDSGLSVV

What is claimed is:

1. An isolated antibody or an antigen-binding fragment thereof that specifically binds to Respiratory Syncytial Virus (RSV) F protein comprising:
   a CDRH1 comprising the amino acid sequence of SEQ ID NO: 947;
   a CDRH2 comprising the amino acid sequence of SEQ ID NO: 949;
   a CDRH3 comprising the amino acid sequence of SEQ ID NO: 951;
   a CDRL1 comprising the amino acid sequence of SEQ ID NO: 955;
   a CDRL2 comprising the amino acid sequence of SEQ ID NO: 957; and
   a CDRL3 comprising the amino acid sequence of SEQ ID NO: 959.

2. The isolated antibody or antigen-binding fragment thereof of claim 1, wherein the antibody or antigen-binding fragment thereof comprises:
   a) a heavy chain (HC) amino acid sequence of SEQ ID NO: 946; and/or
   b) a light chain (LC) amino acid sequence of SEQ ID NO: 954.

3. An isolated nucleic acid sequence encoding an antibody or antigen-binding fragment thereof according to claim 1.

4. An expression vector comprising the isolated nucleic acid sequence according to claim 3.

5. A host cell transfected, transformed, or transduced with the nucleic acid sequence according to claim 3.

6. A pharmaceutical composition comprising: one or more of the isolated antibodies or antigen-binding fragments thereof according to claim 1; and a pharmaceutically acceptable carrier and/or excipient.

7. A pharmaceutical composition comprising: one or more nucleic acid sequences according to claim 3; and a pharmaceutically acceptable carrier and/or excipient.

8. A transgenic organism comprising the nucleic acid sequence according to claim 3.

9. A method of treating or preventing a Respiratory Syncytial Virus (RSV) infection, or at least one symptom associated with RSV infection, comprising administering to a patient in need thereof or suspected of being in need thereof one or more antibodies or antigen-binding fragments thereof according to claim 1 such that the RSV infection is treated or prevented, or the at least one symptom associated with RSV infection is treated, alleviated, or reduced in severity.

10. A method of treating or preventing either a Respiratory Syncytial Virus (RSV) infection or a human metapneumovirus (HMPV) infection, or at least one symptom associated with said RSV infection or said HMPV infection, comprising administering to a patient in need thereof or suspected of being in need thereof one or more antibodies or antigen-binding fragments thereof according to claim 1 such that the RSV infection is treated or prevented, or the at least one symptom associated with RSV infection is treated, alleviated, or reduced in severity.

11. The method according to claim 9, wherein the method further comprises administering to the patient a second therapeutic agent.

12. The method according to claim 11, wherein the second therapeutic agent is selected from the group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

13. A pharmaceutical composition comprising any one or more of the isolated antibodies or antigen-binding fragments thereof of claim 1 and a pharmaceutically acceptable carrier and/or excipient.

14. The pharmaceutical composition according to claim 13 for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

15. The pharmaceutical composition according to claim 13 for use in treating or preventing either a Respiratory Syncytial Virus (RSV) infection or a human metapneumovirus (HMPV) infection, or at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

16. Use of the pharmaceutical composition of claim 13 in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

17. Use of the pharmaceutical composition of claim 13 in the manufacture of a medicament for preventing either a Respiratory Syncytial Virus (RSV) infection or a human metapneumovirus (HMPV) infection, or at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

18. The isolated antibody or antigen-binding fragment thereof of claim 1, wherein at least one of heavy chain variable region (HC) and light chain variable region (LC) amino acid sequences of the antibody or the antigen-binding fragment thereof is at least 70% identical; at least 75% identical; at least 80% identical; at least 85% identical; at least 90% identical; at least 95% identical; at least 96% identical; at least 97% identical; at least 98% identical; at least 99%; and/or all percentages of identity in between; to at least one of heavy chain variable region (HC) comprising the amino acid sequence of SEQ ID NO: 946; and/or light chain variable region (LC) comprising the amino acid sequence of SEQ ID NO: 954.

\* \* \* \* \*